United States Patent
Bernett et al.

(10) Patent No.: US 11,084,863 B2
(45) Date of Patent: Aug. 10, 2021

(54) TARGETED HETERODIMERIC FC FUSION PROTEINS CONTAINING IL-15 IL-15ALPHA AND ANTIGEN BINDING DOMAINS

(71) Applicant: Xencor, Inc., Monrovia, CA (US)

(72) Inventors: Matthew J. Bernett, Monrovia, CA (US); John Desjarlais, Pasadena, CA (US); Rajat Varma, Monrovia, CA (US); Suzanne Schubbert, Long Beach, CA (US); Juan Diaz, Anaheim Hills, CA (US)

(73) Assignee: Xencor, Inc., Monrovia, CA (US)

( * ) Notice: Subject to any disclaimer, the term of this patent is extended or adjusted under 35 U.S.C. 154(b) by 0 days.

(21) Appl. No.: 16/025,963

(22) Filed: Jul. 2, 2018

(65) Prior Publication Data

US 2019/0016778 A1 Jan. 17, 2019

Related U.S. Application Data

(60) Provisional application No. 62/527,898, filed on Jun. 30, 2017.

(51) Int. Cl.

| | |
|---|---|
| *C07K 14/735* | (2006.01) |
| *A61K 39/395* | (2006.01) |
| *C07K 14/54* | (2006.01) |
| *C12N 15/63* | (2006.01) |
| *A61P 35/00* | (2006.01) |
| *C07K 16/28* | (2006.01) |
| *C07K 14/715* | (2006.01) |
| *C12N 15/62* | (2006.01) |
| *A61K 39/00* | (2006.01) |
| *A61K 38/17* | (2006.01) |
| *A61K 38/20* | (2006.01) |

(52) U.S. Cl.
CPC ...... *C07K 14/70535* (2013.01); *A61K 39/395* (2013.01); *A61P 35/00* (2018.01); *C07K 14/5443* (2013.01); *C07K 14/7155* (2013.01); *C07K 16/2803* (2013.01); *C07K 16/2815* (2013.01); *C12N 15/62* (2013.01); *C12N 15/63* (2013.01); *A61K 38/1774* (2013.01); *A61K 38/2086* (2013.01); *A61K 2039/505* (2013.01); *C07K 2317/21* (2013.01); *C07K 2317/24* (2013.01); *C07K 2317/33* (2013.01); *C07K 2317/524* (2013.01); *C07K 2317/526* (2013.01); *C07K 2317/55* (2013.01); *C07K 2317/74* (2013.01); *C07K 2317/92* (2013.01); *C07K 2317/94* (2013.01); *C07K 2319/00* (2013.01); *C07K 2319/30* (2013.01); *C07K 2319/32* (2013.01)

(58) Field of Classification Search
CPC .......... A61K 2300/00; A61K 2039/505; A61K 35/17; A61K 38/00; A61K 39/39558; A61K 38/1793; A61K 45/06; A61P 35/00; C07K 2319/30; C07K 14/5443; C07K 35/17; C07K 38/00; C07K 14/7155; C07K 16/2818; C12N 2501/599; C12N 2501/998; C12N 2510/02; C12N 2710/10371; C12N 5/0006; C12N 5/0037; C12N 5/005; C12N 5/0638; G01N 33/57407; G01N 3/6803

See application file for complete search history.

(56) References Cited

U.S. PATENT DOCUMENTS

| | | |
|---|---|---|
| 3,773,919 A | 11/1973 | Boswell et al. |
| 4,169,888 A | 10/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,322,348 A | 3/1982 | Asai et al. |
| 4,331,598 A | 5/1982 | Hasegawa et al. |
| 4,361,650 A | 5/1982 | Asai et al. |
| 4,362,663 A | 12/1982 | Kida et al. |
| 4,364,866 A | 12/1982 | Asai et al. |
| 4,364,935 A | 12/1982 | Kung et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |

(Continued)

FOREIGN PATENT DOCUMENTS

| | | |
|---|---|---|
| EP | 0425235 B1 | 9/1996 |
| EP | 0927254 | 6/2005 |

(Continued)

OTHER PUBLICATIONS

Wells, 1990, Biochemistry 29:8509-8517.*

(Continued)

*Primary Examiner* — Bridget E Bunner
*Assistant Examiner* — Fozia M Hamud
(74) *Attorney, Agent, or Firm* — Jennifer K. Ng; Christopher J. Betti; Morgan, Lewis & Bockius, LLP

(57) ABSTRACT

The present invention is directed to a novel targeted heterodimeric Fc fusion proteins comprising an IL-15/IL-15Rα Fc fusion protein and an antigen binding domain Fc fusion proteins. In some instances, the antigen binding domain binds to CD8, NKG2A, or NKG2D.

16 Claims, 165 Drawing Sheets
Specification includes a Sequence Listing.

(56) References Cited

U.S. PATENT DOCUMENTS

| | | |
|---|---|---|
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Mateo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,737,056 B1 | 5/2004 | Presta |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,276,585 B2 | 10/2007 | Lazar et al. |
| 7,303,749 B1 | 12/2007 | Chari |
| 7,355,008 B2 | 4/2008 | Stavenhagen et al. |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,632,497 B2 | 12/2009 | Stavenhagen |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 7,834,152 B2 | 11/2010 | Strom et al. |
| 7,858,081 B2 | 12/2010 | Bernard et al. |
| 7,960,512 B2 | 6/2011 | Stavenhagen et al. |
| 8,003,774 B2 | 8/2011 | Stavenhagen et al. |
| 8,063,187 B2 | 11/2011 | Chu et al. |
| 8,114,967 B2 | 2/2012 | Bhatt et al. |
| 8,124,084 B2 | 2/2012 | LeFrancois et al. |
| 8,192,737 B2 | 6/2012 | Stavenhagen et al. |
| 8,216,574 B2 | 7/2012 | Stavenhagen |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,629,245 B2 | 1/2014 | Georgiou et al. |
| 8,637,641 B2 | 1/2014 | Dahiyat et al. |
| 8,679,493 B2 | 3/2014 | Georgiou et al. |
| 8,742,074 B2 | 6/2014 | Behrens et al. |
| 8,871,912 B2 | 10/2014 | Davis et al. |
| 8,901,283 B2 | 12/2014 | Spee et al. |
| 8,940,288 B2 | 1/2015 | LeFrancois et al. |
| 8,940,289 B2 | 1/2015 | Wong et al. |
| 8,946,387 B2 | 2/2015 | Koenig et al. |
| 8,951,517 B2 | 2/2015 | Stavenhagen et al. |
| 9,028,815 B2 | 5/2015 | Stavenhagen et al. |
| 9,150,663 B2 | 10/2015 | Labrijn et al. |
| 9,308,258 B2 | 4/2016 | Kannan et al. |
| RE45,992 E | 5/2016 | Behrens et al. |
| 9,365,630 B2 | 6/2016 | LeFrancois et al. |
| 9,371,368 B2 | 6/2016 | LeFrancois et al. |
| 9,464,127 B2 | 10/2016 | Wong et al. |
| 9,493,533 B2 | 11/2016 | Bernard et al. |
| 9,505,848 B2 | 11/2016 | Davis et al. |
| 9,527,926 B2 | 12/2016 | Ho et al. |
| 9,562,109 B2 | 2/2017 | Von Kreudenstein et al. |
| 9,683,052 B2 | 6/2017 | Blein et al. |
| 9,683,053 B2 | 6/2017 | Blein et al. |
| 9,763,705 B2 | 9/2017 | Faulhaber |
| 9,763,765 B2 | 9/2017 | Horan et al. |
| 9,822,181 B2 | 11/2017 | Bonvini et al. |
| 9,856,327 B2 | 1/2018 | Bernett et al. |
| 9,931,377 B2 | 4/2018 | Pavlakis et al. |
| 9,932,387 B2 | 4/2018 | LeFrancois et al. |
| 9,969,790 B2 | 5/2018 | LeFrancois et al. |
| 10,011,858 B2 | 7/2018 | Igawa et al. |
| 10,138,303 B2 | 11/2018 | Ho et al. |
| 10,350,270 B2 | 7/2019 | McCauley |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winekl |
| 2003/0157108 A1 | 8/2003 | Presta |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |

(56) References Cited

U.S. PATENT DOCUMENTS

| | | |
|---|---|---|
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2006/0263857 A1 | 11/2006 | LeFrancois et al. |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0163699 A1 | 6/2009 | Desjarlais |
| 2009/0214539 A1 | 8/2009 | Grosmaire et al. |
| 2009/0238791 A1 | 9/2009 | Jacques et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Alley et al. |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0267934 A1 | 10/2010 | Van de Winkel et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0149876 A1 | 6/2012 | Von Kreudenstein et al. |
| 2012/0156207 A1 | 6/2012 | Chu et al. |
| 2012/0177595 A1 | 7/2012 | Wong et al. |
| 2012/0251531 A1 | 10/2012 | Baehner et al. |
| 2012/0251541 A1 | 10/2012 | Baurin et al. |
| 2013/0039913 A1 | 2/2013 | Labrijn et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0131319 A1 | 5/2013 | Igawa et al. |
| 2013/0142793 A1 | 6/2013 | Ledbetter et al. |
| 2013/0171095 A1 | 7/2013 | Bernett et al. |
| 2013/0178605 A1 | 7/2013 | Blein et al. |
| 2013/0195849 A1 | 8/2013 | Von Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0072581 A1 | 3/2014 | Dixit et al. |
| 2014/0086916 A1 | 3/2014 | Zha |
| 2014/0187753 A1 | 7/2014 | Blein et al. |
| 2014/0199294 A1 | 7/2014 | Mimoto et al. |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0335089 A1 | 11/2014 | Igawa et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2015/0351275 A1 | 12/2015 | Imbimbo et al. |
| 2016/0060360 A1 | 3/2016 | Moore et al. |
| 2016/0068584 A1 | 3/2016 | Bechard et al. |
| 2016/0068588 A1 | 3/2016 | Bernett et al. |
| 2016/0157951 A1 | 6/2016 | Schoenig et al. |
| 2016/0175459 A1 | 6/2016 | Gey et al. |
| 2016/0176969 A1 | 6/2016 | Bernett et al. |
| 2016/0184399 A1 | 6/2016 | Bechard et al. |
| 2016/0215063 A1 | 7/2016 | Bernett et al. |
| 2016/0229924 A1 | 8/2016 | Bernett et al. |
| 2016/0318986 A1 | 11/2016 | Morisseau et al. |
| 2016/0333067 A1 | 11/2016 | LeFrancois et al. |
| 2016/0347818 A1 | 12/2016 | LeFrancois et al. |
| 2016/0355608 A1 | 12/2016 | Bernett et al. |
| 2016/0367635 A1 | 12/2016 | Wong et al. |
| 2017/0020963 A1 | 1/2017 | Qu et al. |
| 2017/0056874 A1 | 3/2017 | Bechard et al. |
| 2017/0088597 A1 | 3/2017 | Wong et al. |
| 2017/0145078 A1 | 5/2017 | Davis et al. |
| 2017/0151310 A1 | 6/2017 | Felber et al. |
| 2017/0233497 A1 | 8/2017 | Labrijn et al. |
| 2018/0094077 A1 | 4/2018 | Blein et al. |
| 2018/0118805 A1 | 5/2018 | Bernett et al. |
| 2018/0118828 A1 | 5/2018 | Bernett et al. |
| 2018/0194860 A1 | 7/2018 | Von Kreudenstein et al. |
| 2018/0200366 A1 | 7/2018 | Wong et al. |
| 2018/0298079 A1 | 10/2018 | LeFrancois et al. |
| 2018/0312560 A1 | 11/2018 | Morisseau et al. |

FOREIGN PATENT DOCUMENTS

| | | |
|---|---|---|
| EP | 1752471 | 2/2007 |
| EP | 1829895 | 5/2007 |
| EP | 3263581 | 1/2008 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 1718670 | 7/2011 |
| EP | 1934353 | 10/2011 |
| EP | 2155788 | 2/2014 |
| EP | 2388266 | 4/2014 |

(56) References Cited

FOREIGN PATENT DOCUMENTS

| | | |
|---|---|---|
| EP | 2724728 | 4/2014 |
| EP | 2986312 | 2/2016 |
| EP | 3030262 | 6/2016 |
| EP | 3093295 | 11/2016 |
| EP | 3113858 | 1/2017 |
| EP | 2769984 | 8/2017 |
| EP | 3235830 | 10/2017 |
| EP | 3252078 | 12/2017 |
| EP | 3030575 | 7/2018 |
| EP | 2724728 | 10/2018 |
| EP | 2723869 B1 | 2/2019 |
| EP | 3265478 B1 | 9/2019 |
| EP | 3030262 B1 | 10/2019 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO1997041232 | 11/1997 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO200124763 A2 | 4/2001 |
| WO | WO200129246 A1 | 4/2001 |
| WO | WO200162931 A1 | 8/2001 |
| WO | WO01/71005 A2 | 9/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005085282 | 9/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2007001677 | 1/2007 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO2007147901 | 12/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |
| WO | WO2008124858 | 10/2008 |
| WO | WO2008143794 | 11/2008 |
| WO | WO2008145142 | 12/2008 |
| WO | WO2008150494 | 12/2008 |
| WO | WO2009000006 | 12/2008 |
| WO | WO2009002562 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009036209 | 3/2009 |
| WO | WO2009/077483 A1 | 6/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010017103 | 2/2010 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010136172 | 12/2010 |
| WO | WO2010151792 | 12/2010 |
| WO | WO2010151808 | 12/2010 |
| WO | WO2011005621 | 1/2011 |
| WO | WO2011020047 A1 | 2/2011 |
| WO | WO2011028952 | 3/2011 |
| WO | WO2011036183 | 3/2011 |
| WO | WO2011066342 | 3/2011 |
| WO | WO2011063348 | 5/2011 |
| WO | WO2011066501 | 6/2011 |
| WO | WO2011131746 | 10/2011 |
| WO | WO2011133886 | 10/2011 |
| WO | WO2011143545 | 11/2011 |
| WO | WO2011131746 | 12/2011 |
| WO | WO2012016227 | 2/2012 |
| WO | WO2012018687 | 2/2012 |
| WO | WO2012032080 | 3/2012 |
| WO | WO2012040323 A2 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2012131555 | 12/2012 |
| WO | WO2012175222 | 12/2012 |
| WO | WO2013006544 | 1/2013 |
| WO | WO2013016714 | 1/2013 |
| WO | WO2013022855 | 2/2013 |
| WO | WO2013026833 | 2/2013 |
| WO | WO2013033008 | 3/2013 |
| WO | WO2013/055809 | 4/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013125667 | 8/2013 |
| WO | WO2013180201 | 12/2013 |
| WO | WO2014004586 | 1/2014 |
| WO | WO2014012085 | 1/2014 |
| WO | WO2014047231 | 3/2014 |
| WO | WO2014056783 | 4/2014 |
| WO | WO2014079000 | 5/2014 |

(56) References Cited

FOREIGN PATENT DOCUMENTS

| | | |
|---|---|---|
| WO | WO2014/110601 | 7/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014170032 | 10/2014 |
| WO | WO2014209804 | 12/2014 |
| WO | WO2015018528 | 2/2015 |
| WO | WO2015018529 | 2/2015 |
| WO | WO2015026892 | 2/2015 |
| WO | WO2015063339 | 5/2015 |
| WO | WO2015095392 | 6/2015 |
| WO | WO2015095410 | 6/2015 |
| WO | WO2015103072 | 7/2015 |
| WO | WO2015103928 | 7/2015 |
| WO | WO2015131994 | 9/2015 |
| WO | WO2015143079 | 9/2015 |
| WO | WO2015149077 | 10/2015 |
| WO | WO2015184207 | 12/2015 |
| WO | WO2016004060 | 1/2016 |
| WO | WO2016014984 | 1/2016 |
| WO | WO2016028896 | 2/2016 |
| WO | WO2016079050 | 5/2016 |
| WO | WO2016086186 | 6/2016 |
| WO | WO2016086189 | 6/2016 |
| WO | WO2016086196 | 6/2016 |
| WO | WO2016095642 | 6/2016 |
| WO | WO2016105450 | 6/2016 |
| WO | WO2016106159 | 6/2016 |
| WO | WO2016141387 | 9/2016 |
| WO | WO2016142314 | 9/2016 |
| WO | WO2016182751 | 11/2016 |
| WO | WO2017112775 | 6/2017 |
| WO | WO2017210443 | 12/2017 |
| WO | WO2017210485 | 12/2017 |
| WO | WO2017214092 | 12/2017 |
| WO | WO2018071918 | 4/2018 |
| WO | WO2018071919 | 4/2018 |
| WO | WO2018091661 | 5/2018 |
| WO | WO2019006472 | 1/2019 |
| WO | WO2019204665 | 10/2019 |
| WO | WO2020/132646 A1 | 6/2020 |

OTHER PUBLICATIONS

Bork, 2000, Genome Research 10:398-400.*
Skolnick et al., 2000, Trends in Biotech. 18(1):34-39.*
Doerks et al., 1998, Trends in Genetics 14:248-250.*
Tokuriki and Tawfik, Current Opinion in Structural Biology 2009, 19: 596-604.*
Robinson et al, Immunology letter, 2017, vol. 190, pp. 159-168.*
Han et al., IL-15:IL-15 receptor alpha superagonist complex: high-level co-expression in recombinant mammalian cells, purification and characterization., Cytokine. Dec. 2011;56(3):804-10.
Stone et al., Design and characterization of a protein superagonist of IL-15 fused with IL-15Rα and a high-affinity T cell receptor., Biotechnol Prog. Nov.-Dec. 2012;28(6):1588-97.
Kermer et al., An antibody fusion protein for cancer immunotherapy mimicking IL-15 trans-presentation at the tumor site., Mol Cancer Ther. Jun. 2012;11(6):1279-88.
Kermer et al., Combining Antibody-Directed Presentation of IL-15 and 4-1BBL in a Trifunctional Fusion Protein for Cancer Immunotherapy, Mol Cancer Ther. Jan. 2014;13(1):112-21.
C. Bergamaschi et al, "Intracellular Interaction of Interleukin-15 with Its Receptor during Production Leads to Mutual Stabilization and Increased Bioactivity", Journal of Biological Chemistry, vol. 283, No. 7, pp. 4189-4199, 2005.
Mortier E et al, "Natural, Proteolytic Release of a Soluble Form of Human IL-15 Receptor α-Chain That Behaves as a Specific, High Affinity IL-15 Antagonist", J. Immunol 2004; 173: 1681-1688.
Matthew J Bernett et al: Abstract 5565: Potency-reduced IL15/IL15R[alpha] heterodimeric Fc-fusions display enhanced in vivo activity through increased exposure 11 , Cancer Research, vol. 78, No. 13(Suppl)., Apr. 18, 2018 (Apr. 18, 2018), pp. 1-2, XP055658295. abstract.
Kowalsky Stacy Jet al: "Superagonist IL-15-Armed Oncolytic Virus Elicits Potent Antitumor Immunity and Therapy That Are Enhanced with PD-1 Blockade", Molecular Therapy, Nature Publishing Group, GB, vol. 26, No. 10, Oct. 3, 2018 (Oct. 3, 2018), pp. 2476-2486, XP002794091, ISSN: 1525-0024, DOI: 10.1016/J.YMTHE.2018. 07.013 abstract, figures 5 and 6.
John M Wrangle et al: "ALT-803, an IL-15 superagonist, in combination with nivolumab in patients with metastatic non-small cell lung cancer: a non randomised, open-label, phase Ib trial", The Lancet Oncology, vol. 19, No. 5, Apr. 5, 2018 (Apr. 5, 2018), pp. 694-704, XP055605963, DOI: 10.1016/S1470-2045(18)30148-7 abstract, figures 2, 3 table 3.
U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.
"Polythene Glycol and Derivatives for Advanced PEGylation", Catalog 2005-2006, Nektar Therapeutics.
"Xencor Provides Data Updates on XmaB Bispecific Antibody Program and Announces Presentations at Upcoming American Society of Hematology 2014 Annual Meeting", Nov. 6, 2014, XP055255549, retrieved from the Internet: http://files.shareholder.com/downloads/AMDA-2B2V8N/0x0x792404/77590b72-837a-4085-bc55-78fa500638dc/XNCR_News_2014_11_6_General_Releases.pdf.
Abbott Laboratories, Strategies and Current Approaches for Improving Drug-Like-Properties During Biologics Drug Candidate Selection, AAPS Webinar—Nov. 10, 2011.
Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.
Alberola-Ila et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.
Aplin et al., Preparation, properties, and applications of carbohydrate conjugates of proteins and lipids, 1981, CRC Crit. Rev. Biochem., pp. 259-306.
Arnett, et al., Crystal structure of a human CD3-ε/σ dimer in complex with a UCHT1 single-chain antibody fragment, PNAS, 2004, vol. 101, No. 46, pp. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.
Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baca et al., Antibody humanization using monovalent phage display, 1997, J. Biol. Chem. 272(16):10678-10684.
Baeuerle, et al., Response to Letter, "Correct TandAb protein," Molecular Immunology, 2007, vol. 44, p. 3084.
Baeuerle, et al., Review—Bispecific T-Cell Engaging Antibodies for Cancer Therapy, Cancer Res, 2009, vol. 69: (12), pp. 4941-4944.
Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.

(56) References Cited

OTHER PUBLICATIONS

Bargou et al., Tumor Regression in Cancer Patients by Very Low Doses of a T Cell-Engaging Antibody, Science, 2008, vol. 321, pp. 974-977.

Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.

Bhatt, Sea Lane—DDD presentation, "Surrobodies™—A Novel Approach to Bispecifics . . . ," Aug. 8, 2012.

Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.

Biochemica, Your apoptosis specialist, 1999, No. 2, pp. 34-37 (Roche Molecular Biochemicals).

Bird et al., Single-chain antigen-binding proteins, 1988, Science 242:423-426.

Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.

Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.

Bortoletto, Nicola et al., "Optomizing anti-CD3 affinity for effective T cell targeting against tumor cells.", Eur J Immunol. Nov. 2002;32(11):3102-7.

Boswell et al., Effects of Charge on Antibody Tissue Distribution and Pharmacokinetics, 2010, Bioconjugate Chem, 21(21):2153-2163.

Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.

Brinkmann, et al., A recombinant immunotoxin containing a disulfide-stabilized Fv fragment, Proc. Natl. Acad. Sci. USA, 1993, vol. 90, pp. 7538-7542.

Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.

Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.

Carter et al., Antibody-drug conjugates for cancer therapy, 2008, Cancer J. 14(3):154-169.

Carter et al., Humanization of an anti-p185HER2 antibody for human cancer therapy, 1992, Proc Natl Acad Sci USA 89:4285-9.

Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.

Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.

Chames et al., Bispecific antibodies for cancer therapy—The light at the end of the tunnel?, mAbs, 2009, vol. 1, Issue 6, pp. 1-9.

Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.

Chari et al., Immunoconjugates containing novel maytansinoids: promising anticancer drugs, 1992, Cancer Research 52: 127-131.

Chatal, 1989, Monoclonal Antibodies in Immunoscintigraphy, CRC Press (Book Abstract).

Chelius, et al., Structural and functional characterization of the trifunctional antibody catumaxomab, mAbs, 2010, vol. 2, Issue 3, pp. 309-319.

Chichili et al., A CD3×CD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.

Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.

Chothia et al., Canonical structures for the hypervariable regions of immunoglobulins, 1987, J. Mol. Biol. 196:901-917.

Chothia, et al., Structural Determinants in the Sequences of Immunoglobulin Variable Domain, J. Mol. Biol., 1998, vol. 278, pp. 457-479.

Chu et al., Immunotherapy with Long-Lived Anti-CD123×Anti-CD3 Bispecific Antibodies Stimulates Potent T Cell Mediated Killing of Human AML Cell Lines and of CD123+ Cells in Monkeys: A Potential Therapy for Acute Myelogenous Leukemia, Blood 2014, 124:2316.

Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.

Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.

Conrad, et al., TCR and CD3 Antibody Cross-Reactivity in 44 Species, Cytometry Part A, 2007, vol. 71A, pp. 925-933.

Conrath, et al., Antigen Binding and Solubility Effects upon the Veneering of a Camel VHH in Framework-2 to Mimic a VH, J. Mol. Biol. , 2005, vol. 350, pp. 112-125.

Counterman et al., "Volumes of Individual Amino Acid Residues in Gas-Phase Peptide Ions.", J. Am. Chem. Soc., 1999, 121 (16), pp. 4031-4039.

Cuesta, et al., Multivalent antibodies: when design surpasses evolution, Trends in Biotechnology, 2010, vol. 28, No. 7, pp. 355-362, doi:10.1016/j.tibtech.2010.03.007.

D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.

Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.

Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.

Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.

De Groot et al., De-Immunization of Therapeutic Proteins by T-Cell Epitope Modification, 2005, Dev. in Biologicals, 2005, 122:171-194.

De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.

Del Nagro et al., A critical role for complement C3d and the B cell coreceptor (CD19/CD21) complex in the initiation of inflammatory arthritis., J Immunol. Oct. 15, 2005;175(8):5379-89.

(56) References Cited

OTHER PUBLICATIONS

Demarest et al., Antibody therapeutics, antibody engineering, and the merits of protein stability, Current Opinin in Drug Discovery & Development, 2008 11(5): 675-587, Sep. 11, 2008.

Deyev, et al., Multivalency: the hallmark of antibodies used for optimization of tumor targeting by design, BioEssays, 2008, vol. 30, pp. 904-918.

DiGiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.

DiGiandomenico et al., *A multifunctional bispecific antibody protects against Pseudomonas aeruginosa.*, Sci Transl Med. Nov. 12, 2014;6(262):262ra155.doi: 10.1126/scitranslmed.3009655.

Dixon, et al., Activation of Human T Lymphocytes by Crosslinking of Anti-CD3 Monoclonal Antibodies, Journal of Leukocyte Biology, 1989, vol. 46, pp. 214-220.

Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.

Doronina , Development of potent monoclonal antibody auristatin conjugates for cancer therapy, 2003, Nat Biotechnol 21(7):778-784.

Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.

Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.

Dubowchik et al., Receptor-mediated and enzyme-dependent targeting of cytotoxic anticancer drugs, 1999, Pharm. Therapeutics 83:67-123.

Ducry et al., Antibody-drug conjugates: linking cytotoxic payloads to monoclonal antibodies, 2010, Bioconjugate Chem. 21:5-13.

Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.

Duke, et al., Measurement of apoptosis and other forms of cell death, 2004, Curr protocols immunol. 3.17.1-3.17.16.

DukSin et al., Relationship of the structure and biological activity of the natural homologues of tunicamycin, 1982, J. Biol. Chem. 257:3105.

Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.

Edge et al., Deglycosylation of glycoproteins by trifluoromethanesulfonic acid, 1981, Anal. Biochem. 118:131.

Elliott, et al., Antiparallel Conformation of Knob and Hole Aglycosylated Half-Antibody Homodimers Is Mediated by a CH2-CH3 Hydrophobic Interaction, Journal of Molecular Biology, 2014, vol. 426, Issue 9, pp. 1947-1957.

Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.

Feldmann et al., Retargeting of T Cells to Prostate Stem Cell Antigen Expressing Tumor Cells: Comparison of Different Antibody Formats, Dec. 28, 2010.

Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.

Fischer, Nicolas et al., "Bispecifc antibodies: molecules that enable novel therapeutic strategies", 2007, vol. 74, pp. 3-14.

Foreman, et al., ErbB3 Inhibitory Surrobodies Inhibit Tumor Cell Proliferation In Vitro and In Vivo, Mol Cancer Ther, 2012, vol. 11(7) , pp. 1411-1420.

Foreman, et al., PEGS poster, "ErbB3 Inhibitory Surrobodies Inhibit Tumor Cell Proliferation In Vitro and In Vivo," 2012.

Fraker et al., Crystal structure of peptide cyclo-(D-VAL-L-PRO-L-VAL-D-PRO)$_3$, 1978, Biochem. Biophys. Res. Commun. 80(4):849-57.

Francois, et al., Construction of a Bispecific Antibody Reacting with the α- and β-Chains of the Human IL-2 Receptor, The Journal of Immunology, May 15, 1993, vol. 150, No. 10, pp. 4610-4619.

F-star Modular Antibodies Fact Sheet, Apr. 2008, "Modular Antibody Technology" (w/ reference to Ruker WO 2006/072620 A1).

F-star Modular Antibodies Press Release, Mar. 28, 2008, "Antibody Engineering Company F-Star Buys Back Royalty Obligations. TVM Capital Joins Investor Syndicate."

Fudenberg, et al., Serologic Demonstration of Dual Specificity of Rabbit Bivalent Hybrid Antibody, The Journal of Experimental Medicine, 1964, vol. 119(1), pp. 151-166.

Ganesan, et al., FcγRIIb on Liver Sinusoidal Endothelium Clears Small Immune Complexes, The Journal of Immunology, Nov. 15, 2012, vol. 189 No. 10, pp. 4981-4988.

Ghendler et al., One of the CD3ε Subunits within a T Cell Receptor Complex Lies in Close Proximity to the Cβ FG Loop, J. Exp. Med., 1998, vol. 187, No. 9. pp. 1529-1536.

Ghetie et al., Multiple roles for the major histocompatibility complex Class I-related receptor FcRn, 2000, Annu Rev Immunol 18:739-766.

Gilliland, et al., Universal bispecific antibody for targeting tumor cells for destruction by cytotoxic T cells, Proc. Natl. Acad. Sci. USA, 1988, vol. 85, pp. 7719-7723.

Gorman et al., Reshaping a therapeutic CD4 antibody, Proc. Natl. Acad. Sci. USA 88:4181-4185.

Grodzki & Bernstein, "Antibody Purification: Ion-Exchange Chromatography.", Methods Mol Biol 2010 ;588:27-32.

Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.

Haagen, et al., The Efficacy of CD3×CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.

Hakimuddin et al., A chemical method for the deglycosylation of proteins, 1987, Arch. Biochem. Biophys. 259:52.

Hamel, et al., The Role of the $V_L$- and $V_H$-Segments in the Preferential Reassociation of Immunoglobulin Subunits, Molecular Immunology, 1986, vol. 23, No. 5, pp. 503-510.

HAwkins et al, Selection of phage antibodies by binding affinity mimicking affinity maturation, 1992, J. Mol. Biol. 226:889-896.

Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.

He et al., Humanization and pharmacokinetics of a monoclonal antibody with specificity for both E- and P-selectin, 1998, J. Immunol. 160:1029-1035.

Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-81376-60CF58B8C06F/CPI_bispecifics.pdf.

Hennecke et al., "Non-repetitive single-chain Fv linkers selected by selectively infective phage (SIP) technology.", Protein Eng. May 1998;11(5):405-10.

Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.

Hexham, et al., Influence of relative binding affinity on efficacy in a panel of anti-CD3 scFv immunotoxins, Molecular Immunology, 2001, vol. 38, pp. 397-408.

(56) References Cited

OTHER PUBLICATIONS

Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.
Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain FV-$C_H3$) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83, 2008.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconguates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al., Structural understanding of stabilization patterns in engineered bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.
Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci USA. 100(2):639-44.
Kabat et al., 1991, Sequences of proteins of immunological interest, Department of Health and Human Services, Bethesda, vol. 1, $5^{th}$ Ed.
Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.
Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.
Kettleborough et al., Humanization of a mouse monoclonal antibody by CDR-grafting: the importance of framework residues on loop conformation, 1991, Protein Eng. 4(7):773-83.
Keyna, et al., Surrogate Light Chain-Dependent Selection of Ig Heavy Chain V Regions, J. Immunol., 1995, vol. 155, pp. 5536-5542.
Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.
Kiewe, et al., Phase I Trial of the Trifunctional Anti-HER2 × Anti-CD3 Antibody Ertumaxomab in Metastatic Breast Cancer, Clin Cancer Res., 2006, vol. 12(10), pp. 3085-3091.
Kim et al., "Localization of the site of murine IgG1 molecule that is involved in binding the murine intestinal Fc receptor," Eur. J. Immunol., 24:2429-2434, 1994.
Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.
Kipriyanov, et al., Bispecific CD3×CD19 Diabody for T Cell-Mediated Lysis of Malignant Human B Cells, Int. J. Cancer, 1998. vol. 77, pp. 763-772.
Kipriyanov, et al., Bispecific Tandem Diabody for Tumor Therapy with Improved Antigen Binding and Pharmacokinetics, J. Mol. Biol., 1999, vol. 293, pp. 41-56.
Kipriyanov, et al., Effect of Domain Order on the Activity of Bacterially Produced Bispecific Single-chain Fv Antibodies, J. Mol. Biol., 2003, vol. 330, pp. 99-111.
Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.
Klein et al., Progression of metastatic human prostate cancer to androgen independence in immunodeficient SDIC mice, 1997, Nature Medicine 3: 402-408.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.
Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.
Kostelny, et al., Formation of a Bispecific Antibody by the Use of Leucine Zippers, The Journal of Immunology 1992, vol. 148, pp. 1547-1553.
Krah et al., "Single-domain antibodies for biomedical applications.", Immunopharmacol Immunotoxicol. 2016;38(1):21-8. doi: 10.3109/08923973.2015.1102934. Epub Nov. 9, 2015.
Krauss et al., Specificity grafting of human antibody frameworks selected from a phage display library: generation of a highly stable humanized anti-CD22 single-chain Fv fragment, 2003, Protein Engineering 16(10):753-759.
Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.
Kung, et al., Monoclonal Antibodies Defining Distinctive Human T Cell Surface Antigens, Science, 1979, vol. 206, pp. 347-349.

(56) References Cited

OTHER PUBLICATIONS

Kuppen, peter et al., The development and purification of a bispecific antibody for lymphokine-activated killer cell targeting against the rat colon carcinoma CC531., Cancer Immunol Immunother. Jun. 1993;36(6):403-8.
Laszlo et al., Cellular determinants for preclinical activity of a novel CD33/CD3 bispecific T-cell engager (BiTE) antibody, AMG 330, against human AML, blood 2014 123: 554-561, Dec. 5, 2013.
Lau et al., Conjugation of Doxorubicin to monoclonal anti-carcinoembryonic antigen antibody via novel thiol-directed cross-linking regents, 1995, Bioorg-Med-Chem. 3(10):1299-1304.
Lau et al., Novel doxorubicin-monoclonal anti-carcinoembryonic antigen antibody immunoconjugate activity in vitro, 1995, Bioorg-Med-Chem. 3(10):1305-12.
Lazar Declaration, Dec. 27, 2010, pp. 1-4.
Lewis, et al., Generation of bispecific IgG antibodies by structure-based design of an orthogonal Fab interface, Nature Biotechnology, 2014, doi:10.1038/nbt.2797 & Supplemental Information.
Li, et al., Construction and characterization of a humanized anti-human CD3 monoclonal antibody 12F6 with effective immunoregulation functions, Immunology, 2005, vol. 116, pp. 487-498.
Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.
Ling, et al., Interspecies Scaling of Therapeutic Monoclonal Antibodies: Initial Look, J Clin Pharmacol, 2009, vol. 49, pp. 1382-1402, doi: 10.1177/0091270009337134.
Link, et al., Production and Characterization of a Bispecific IgG Capable of Inducing T-Cell-Mediated Lysis of Malignant B Cells, Blood, 1993, vol. 81, No. 12, pp. 3343-3349.
Linke, et al., Catumaxomab, Clinical development and future directions, mAbs, 2010, vol. 2, Issue 2, pp. 129-136.
Little, et al., Letter to the Editor, "Flawed TandAb production," Molecular Immunology, 2007, vol. 44, p. 3083.
Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.
Liu et al., Eradication of large colon tumor xenografts by targeted delivery of maytansinoids, 1996 Proc. Natl. Acad. Sci. USA 93:8618-8623.
Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.
Lode et al., Targeted therapy with a novel enediyne antibiotic calicheamicins o$^j$1 effectively suppress growth and dissemination of liver metastases in a syngeneic model of murine neuroblastoma, 1998, Cancer Res. 58:2928.
Löffler, et al., A recombinant bispecific single-chain antibody, CD19×CD3, induces rapid, and high lymphoma-directed cytotoxicity by unstimulated T lymphocytes, Blood, 2000, vol. 95, No. 6, pp. 2098-2103.
Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.
Lu, et al., Di-diabody: a novel tetravalent bispecific antibody molecule by design, Journal of Immunological Methods, 2003, vol. 279, pp. 219-232.
Lu, et al., Fab-scFv fusion protein: an efficient approach to production of bispecific antibody fragments, Journal of Immunological Methods, 2002, vol. 267, pp. 213-226.
Lu, et al., The effect of variable domain orientation and arrangement on the antigen-binding activity of a recombinant human bispecific diabody, Biochemical and Biophysical Research Communications, 2004, vol. 318, pp. 507-513.
Lum, et al., The new face of bispecific antibodies: targeting cancer and much more, Experimental Hematology, 2006, vol. 34, pp. 1-6.
Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.
Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.
Ma, et al., Expression and Characterization of a Divalent Chimeric Anti-Human CD3 Single Chain Antibody, Scand.J.lmmunol, 1996, vol. 43, pp. 134-139.
Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.
Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.
Mack, et al., A small bispecific antibody construct expressed as a functional single-chain molecule with high tumor cell cytotoxicity, Proc. Natl. Acad. Sci. USA, 1995, vol. 92, pp. 7021-7025.
Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.
MacroGenics Factsheet, Dual Affinity Re-Targeting ("DART") Platform, 2010.
Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.
Mandler et al., Modifications in synthesis strategy improve the yield and efficacy of geldanamycin-herceptin immunoconjugates, 2002, Bioconjugate Chem. 13:786-791).
Mandler et al., Synthesis and evaluation of antiproliferative activity of a geldanaymcin-herceptin™ immunoconjugates, 2000, Bioorganic & Med. Chem. Letters 10:1025-1028.
Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.
Mandy, et al., Recombination of Univalent Subunits Derived from Rabbit Antibody, The Journal of Biological Chemistry, 1961, vol. 236, No. 12, pp. 3221-3226.
Marks et al., By-passing immunization: building high affinity human antibodies by chain shuffling, 1992, Biotechnology 10:779-783.
Martin, et al., Generation of the Germline Peripheral B Cell Repertoire: VH81X-λ B Cells Are Unable to Complete All Developmental Programs, J. Immunol., 1998, vol. 160, pp. 3748-3758.
Martinez, et al., Characterization of a novel modification on IgG2 light chain: Evidence for the presence of O-linked mannosylation, J. Chromatogr. A, 2007, vol. 1156 pp. 183-187.
Marvin, Bispecific antibodies for dual-modality cancer therapy: killing two signaling cascades with one stone, Curr Opin Drug Discov Devel, 2006, vol. 9(2), pp. 184-193.
Marvin, et al., Recombinant approaches to IgG-like bispecific antibodies, Acta Pharmacologica Sinica, 2005, vol. 26 (6), pp. 649-658.
Mateo et al, Humanization of a mouse nonoclonal antibody that blocks the epidermal growth factor receptor: recovery of antagonistic activity, 1997, Immunotechnology, 3(1):71-81.
McPhee, Engineering human immunodeficiency virus 1 protease heterodimers as macromolecular inhibitors of viral maturation, Proc. Natl. Acad. Sci. USA, 1996, vol. 93, pp. 11477-11481.
Meijer, et al., Isolation of Human Antibody Repertoires with Preservation of the Natural Heavy and Light Chain Pairing, J. Mol. Biol., 2006, vol. 358, pp. 764-772.
Merchant, et al., An efficient route to human bispecific IgG, Nature Biotechnology, 1998, vol. 16, pp. 677-681.
Mertens, Nico, "Tribodies: Fab-scFv fusion proteins as a platform to create multi-functional pharmaceuticals.", SpringerLink 2011, 135-149.

(56) References Cited

OTHER PUBLICATIONS

Metz, et al., Bispecific antibody derivatives with restricted binding functionalities that are activated by proteolytic processing, Protein Engineering, Design & Selection, 2012, vol. 25, No. 10, pp. 571-580.
Metz, et al., Bispecific digoxigenin-binding antibodies for targeted payload delivery, PNAS, 2011, vol. 108, No. 20, pp. 8194-8199.
Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.
Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.
Miller et al., Stability engineering of scFvs for the development of bispecific and multivalent antibodies, PEDS, 2010, vol. 23, No. 7, pp. 549-557 & Supplementary Data.
Miller, biogen idec Stability Engineering and Production of IgG-like Bispecifc Antibodies, AAPS National Biotechnology Conference, Jun. 24 to Jun. 27, 2007.
Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.
Mimoto, et al., Novel asymmetrically engineered antibody Fc variant with superior FcγR binding affinity and specificity compared with afucosylated Fc variant, mAbs, 2013, vol. 5, Issue 2, pp. 229-236.
Modjtahedi et al, Phase I trial and tumour localization of the anti-EGFR monoclonal antibody ICR62 in head and neck or lung cancer, 1996, Br J Cancer, 73(2):228-35.
Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.
Modjtahedi et al., Antitumor activity of combinations of antibodies directed against different epitopes on the extracellular domain of the human EGF receptor, 1993, J. Cell Biophys. 1993, 22(1-3):129-46.
Modjtahedi et al., The human EGF receptor as a target for cancer therapy: six new rat mAbs against the receptor on the breast carcinoma MDA-MB 468, 1993, Br J Cancer. 1993, 67(2):247-53.
Mølhøj, et al., CD19-/CD3-bispecific antibody of the BiTE class is far superior to tandem diabody with respect to redirected tumor cell lysis, Molecular Immunology 2007, vol. 44, pp. 1935-1943.
Moore et al., Tuning T Cell Affinity Improves Efficacy and Safety of Anti-CD38×Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.
Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.
Moore, et al., Application of dual affinity retargeting molecules to achieve optimal redirected T-cell killing of B-cell lymphoma, Blood, 2011, vol. 117, No. 17, pp. 4542-4551.
Moretti et al., BEAT® the bispecific challenge: a novel and efficient platform for the expression of bispecific IgGs. BMC Proceedings 2013 7(Suppl 6):O9.
Morrison, et al., News and Views: Two heads are better than one, Nature Biotechnology, 2007, vol. 25, No. 11, pp. 1233-1234.
Mosmann, 1983, Rapid colorimetric assay for cellular growth and survival: application to proliferation and cytotoxicity assays, J. Immunol. Methods 65:55-63.
Muda, et al., Therapeutic assessment of SEED: a new engineered antibody platform designed to generate mono and bispecific antibodies, Protein Engineering, Design & Selection, 2011, vol. 24, No. 5, pp. 447-454.
Muramatsu et al., Production and characterization of an active single-chain variable fragment antibody recognizing CD25., Cancer Lett. Jul. 28, 2005;225(2):225-36. Epub Jan. 23, 2005.
Murthy et al., Binding of an antagonistic monoclonal antibody to an intact and fragmented EGF-receptor polypeptide, 1987, Arch Biochem Biophys. 252(2):549-60.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Neville et al., Enhancement of immunotoxin efficacy by acid-cleavable cross-ling agents utilizing diphtheria toxin and toxin mutants, 1989, Biol. Chem. 264:14653-14661.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
O'Connor et al., Humanization of an antibody against human protein C and calcium-dependence involving framework residues, 1998, Protein Eng 11:321-8.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Ott et al., CTLA-4 and PD-1/PD-L1 blockade: new immunotherapeutic. modalities with durable clinical benefit in melanoma patients., Clin Cancer Res. Oct. 1, 2013;19(19):5300-9. doi: 10.1158/1078-0432. CCR-13-0143.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T3-δ and T3-ε) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.
Pettit et al., Dolastatins 24. Synthesis of (−)-dolastatin 10.1 X-ray molecular structure of N,N-dimethylvalyl-valyl-dolaisoleuine tert-butyl ester, 1996, J. Chem. Soc. Perkin Trans. 1 5:859-863.
Pettit et al., Specific activities of dolastatin 10 and peptide derivatives against Cryptococcus neoformans, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproine1, 1996, Synthesis 719-725.
Pichler et al., Differences of T-Cell Activation by the Anti-CD3 Antibodies Leu4 and BMA030, Mar. 30, 1987.
Potapov et al., Protein-Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.
Raghavan et al., Fc receptors and their interactios with immunoglobulins, 1996, Annu Rev Cell Dev Biol 12:181-220.

(56) References Cited

OTHER PUBLICATIONS

Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington's Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering,1996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J. Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.
Rosok et al., A combinatorial library strategy for the rapid humanization of anticarcinoma BR 96 Fab, 1996, J. Biol. Chem. 271(37):22611-22618.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Röthlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3-Surface Expression Is Required for CD4-p56ick-mediated Up-regulation of T Cell Antigen Receptor-CD3 Signaling in T Cells, Apr. 16, 1992.

Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schaefer, et al., Immunoglobulin domain crossover as a generic approach for the production of bispecific IgG antibodies, PNAS, 2011, vol. 108, No. 27, pp. 11187-11192.
Schlapschy, et al., Functional humanization of an anti-CD16 Fab fragment: obstacles of switching from murine λ to human λ or K light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.
Schoonjans, et al., Fab Chains as an Efficient Heterodimerization Scaffold for the Production of Recombinant Bispecific and Trispecific Antibody Derivatives, The Journal of Immunology, 2000, vol. 165, pp. 7050-7057.
Schroder et al., The Peptides, vol. pp. 76-136, 1965, Academic Press.
Senter et al, Proceedings of the American Association for Cancer Research, 2004, vol. 45, Abstract No. 623.
Senter, Potent antibody drug conjugates for cancer therapy, 2009, Current Opin. Chem. Biol. 13:235.
Sforzini et al., Targeting of saporin to Hodgkin's lymphoma cells by anti-CD30 and anti-CD25 bispecific antibodies., Br J Haematol. Sep. 1998;102(4):1061-8.
Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.
Shan, et al., Characterization of scFv-Ig Constructs Generated from the Anti-CD20 mAb 1F5 Using Linker Peptides of Varying Lengths, J Immunol, 1999, vol. 162, pp. 6589-6595.
Shearman, et al., Construction, Expression and Characterization of Humanized Antibodies Directed Against the Human α/β T Cell Receptor, The Journal of Immunology, 1991, vol. 147, No. 12, pp. 4366-4373.
Shen, et al., Catumaxomab, a rat/murine hybrid trifunctional bispecific monoclonal antibody for the treatment of cancer, Curr Opin Mol Ther, 2008, vol. 10(3), pp. 273-284.
Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.
Shields et al., Lack of fucose on human IgG1 N-linked oligosaccharide improves binding to human FcγRIII and antibody-dependent cellular toxicity, 2002, J Biol Chem 277:26733-26740.
Shier et al., Identification of functional and structural amino-acid residues by parsimonious mutagenesis, 1995, Gene 169:147-155.
Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.
Skehan et al., Identification of functional and structural amino-acid residues by parsimonious mutagenesis, 1990, J. Natl. Cancer Inst. 82(13):1107-12.
Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.
Soumyarani et al, Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.

(56) References Cited

OTHER PUBLICATIONS

Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.

Spiess, et al., Bispecific antibodies with natural architecture produced by co-culture of bacteria expressing two distinct half-antibodies, Nature Biotechnology, 2013, doi:10.1038/nbt.2621 & Supplemental Information.

Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.

Stamova, Unexpected recombinations in single chain bispecific anti-CD3-anti-CD33 antibodies can be avoided by a novel linker module, Oct. 29, 2011.

Stanfield, et al. Maturation of Shark Single-domain (IgNAR) Antibodies: Evidence for Induced-fit Binding, J. Mol. Biol., 2007, vol. 367, pp. 358-372.

Stewart, et al., Recombinant CD36 inhibits oxLDL-induced ICAM-1-dependent monocyte adhesion., Mol Immunol. Feb. 2006;43(3):255-67.

Strop, P. et al., Generating Bispecific Human IgG1 and IgG2 Antibodies from Any Antibody Pair, J. Mol. Biol., 2012, doi:10.1016/j.jmb.2012.04.020.

Szymkowski et al., Creating the next generation of protein therapeutics through rational drug design, Current opinion in drug discovery & development, Sep. 1, 2005, p. 590, XP055354917, England.

Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.

Tan et al., "Superhumanized" antibodies: reduction of immunogenic potential by complementarity-determining region grafting with human germline sequences: application to an anti-CD28, 2002, J. Immunol. 169:1119-1125.

Tan, Philip, Presentation at PepTalk, Jan. 25, 2013, "Bi-specific ADAPTIR Molecule Targeting CD86 and Delivering Monomeric IL10 to Inhibit Antigen Presenting Cells".

Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-19258.

Tarcsa et al, Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.

Teachey, et al., Cytokine release syndrome after blinatumomab treatment related to abnormal macrophage activation and ameliorated with cytokine-directed therapy, Blood, 2013, vol. 121, No. 26, pp. 5154-5157.

Tedgui, et al., Cytokines in atherosclerosis: pathogenic and regulatory pathways., Physiol Rev. Apr. 2006;86(2):515-81.

Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.

Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.

Thompson, et al., Improved binding of a bivalent single-chain immunotoxin results in increased efficacy for in vivo T-cell depletion, Protein Engineering, 2001, vol. 14, No. 12, pp. 1035-1041.

Thorne, et al., CD36 is a receptor for oxidized high density lipoprotein: implications for the development of atherosclerosis., FEBS Lett. Mar. 20, 2007;581(6):1227-32. Epub Feb. 28, 2007.

Thorpe et al., New coupling agents for the synthesis of immunotoxins containing a hindered disulfide bond with improved stability in Vivo, 1987, Cancer Res. 47:5924-5931.

Thotakura et al., Enzymatic deglycosylating of glycoproteins, 1987, Meth. Enzymol. 138:350.

Thurman et al., Detection of complement activation using monoclonal antibodies against C3d., J Clin Invest. May 2013;123(5):2218-30. doi: 10.1172/JCI65861. Epub Apr. 24, 2013.

Tomlinson et. al., Methods for generating multivalent and bispecific antibody fragments, 2000, Methods Enzymol. 326:461-479.

Traunecker, et al., Bispecific single chain molecules (Janusins) target cytotoxic lymphocytes on HIV infected cells, The EMBO Journal, 1991, vol. 1, No. 12, pp. 3655-3659.

Tsurushita et al., Humanization of monoclonal antibodies, 2004, Molecular Biology of B Cells 533-545.

Umaña et al., Engineered glycoforms of an antineuro-blastoma IgG1 with optimized antibody-dependent cellular cytotoxic activity, 1999, Nat Biotechnol 17:176-180.

Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.

Van Boxel, et al., Some lessons from the systematic production and structural analysis of soluble $\alpha\beta$ T-cell receptors, Journal of Immunological Methods, 2009, vol. 350, pp. 14-21.

Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.

Verdier, et al., Determination of lymphocyte subsets and cytokine levels in Cynomolgus monkeys, Toxicology, 1995, vol. 105, pp. 81-90.

Verhoeyen et al., Reshaping human antibodies: grafting an antilysozyme activity, 1988, Science, 239:1534-1536.

Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.

Vettermann, et al., Powered by pairing: The surrogate light chain amplifies immunoglobulin heavy chain signaling and pre-selects the antibody repertoire, Seminars in Immunology 18, 2006, pp. 44-55.

Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.

Wang et al., Conserved amino acid networks involved in antibody variable domain interactions, Proteins, 2009, vol. 76, pp. 99-114.

Wang et al., Expression and characterization of recombinant soluble monkey CD3 molecules: mapping the FN18 polymorphic epitope, Molecular Immunology, 2004, vol. 40, pp. 1179-1188.

Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.

Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.

Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.

Weiner, et al., The Role of T Cell Activation Bispecific Antibody Therapy in Anti-CD3 X Antitumor, Journal of Immunology, 1994, vol. 152, pp. 2385-2392.

Wesolowski, et al., Single domain antibodies: promising experimental and therapeutic tools in infection and immunity, Med Microbiol Immunol, 2009, vol. 198, pp. 157-174.

Whitlow, et al., An improved linker for single-chain Fv with reduced aggregation and enhanced proteolytic stability, Protein Engineering, 1993, vol. 6 , No. 8, pp. 989-995.

Wong, et al., The Mechanism of Anti-CD3 Monoclonal Antibodies, Transplantation, 1990, vol. 50, No. 4, pp. 683-689.

(56) References Cited

OTHER PUBLICATIONS

Woods, et al., LC-MS characterization and purity assessment of a prototype bispecific antibody, mAbs, 2013, vol. 5, Issue 5, pp. 711-722, http://dx.doi.org/10.4161/mabs.25488.

Woyke et al., In vitro activities and postantifungal effects of the potent dolastation 10 derivative auristatin PHE, 2001, Antimicrob. Agents and Chemother. 45(12):3580-3584.

Wu et al, Molectular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.

Wu et al, Simultaneous targeting of multiple disease mediators by a dual-variable-domain immunoglobulin, (DVD-Ig™) molecules, Jul.-Aug. 2009; 339-347, Oct. 14, 2007.

Wu et al., Humanization of a murine monoclonal antibody by simultaneous optimization of framework and CDR residues, 1999, J. Mol. Biol. 294:151-162.

Wu, et al., Multimerization of a chimeric anti-CD20 single-chain Fv-Fc fusion protein is mediated through variable domain exchange, Protein Engineering, 2001, vol. 14, No. 12, pp. 1025-1033.

Wucherpfennig, et al., Structural Biology of the T-cell Receptor: Insights into Receptor Assembly, Ligand Recognition, and Initiation of Signaling, Cold Spring Harb Perspect Biol 2010;2:a005140.

Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.

Xu, et al., Combinatorial surrobody libraries, PNAS, 2008, vol. 105, No. 31, pp. 10756-10761.

Xu, et al., Rapid optimization and prototyping for therapeutic antibody-like molecules, mAbs, 2013, vol. 5, Issue 2, pp. 237-254.

Xu, et al., Surrobodies with Functional Tails, J. Mol. Biol., 2010, vol. 397, pp. 352-360.

Yang et al., Differential in vitro activation of CD8—CD4+ and CD4—CD8+ T lymphocytes by combinations of anti-CD2 and anti-CD3 antibodies, Apr. 1, 1988.

Yelton et al., Affinity maturation of the BR96 anti-carcinoma antibody by codon-based mutagenesis, 1995, J. Immunol. 155:1994-2004.

Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.

Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.

Yu et al., The biosynthetic gene cluster of the maytansinoids antitumor agent ansamitocin from actinosynnema pretiosum, 2002, PNAS 99:7968-7973.

Zalevsky et al. "Enhanced antibody half-life improves in vivo activity." Nature Biotechnology, vol. 28, No. 2, Feb. 1, 2010, pp. 157-159.

Zamyatnin AA., Amino acid, peptide, and protein volume in solution., Annu Rev Biophys Bioeng. 1984;13:145-65.

Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.

Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.

Zhu, et al., Remodeling domain interfaces to enhance heterodimer formation, Protein Science, 1997, vol. 6, pp. 781-788.

Ziebig et al., Effect of the oxLDL Binding Protein Fc-CD68 on Plaque Extension and Vulnerability in Atherosclerosis., Circulation Research 108: 695-703, 2011.

Zuo, et al., An efficient route to the production of an IgG-like bispecific antibody, Protein Engineering, 2000, vol. 13, No. 5, pp. 361-367.

Chu et al., Immunotherapy with Long-Lived Anti-CD123×Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.

Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.

Capizzi et al., Curative chemotherapy for acute myeloid leukemia: the development of high-dose ara-C from the laboratory to bedside., Invest New Drugs. 1996;14(3):249-56.

Giles et al., Intravenous corticosteroids to reduce gemtuzumab ozogamicin infusion reactions. Ann Pharmacother. Sep. 2003;37(9):1182-5.

Duong et al., Targeted treatment of acute myeloid leukemia in older adults: role of gemtuzumab ozogamicin., Clin Interv Aging. 2009;4:197-205. Epub May 14, 2009.

Sun et al. , Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.

Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.

Xiaolong et al., The development of bispecific antibodies and their applications in tumor immune escape., Experimental Hematology & Oncology20176:12.

Krupka et al.,Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.

Osada et al., CEA/CD3-bispecific T cell-engaging (BiTE) antibody-mediated T lymphocyte cytotoxicity maximized by inhibition of both PD1 and Pd-L1., Cancer Immunol Immunother. Jun. 2015;64(6):677-88. doi: 10.1007/s00262-015-1671-y. Epub Mar. 6, 2015.

Masarova et al., Immune Checkpoint Approaches in AML and MDS: A Next Frontier?, The Journal of Targeted Therapies in Cancer, Mar. 6, 2017 (Mar. 6, 2017), XP002784099.

Chappel et al., "Identification of a Secondary Fcγ RI Binding Site within a Genetically Engineered Human IgG Actibody," J. Biol. Chem., 268(33):25124-25131 (Nov. 1993).

Chappel et al., "Identification of the Fcγ receptor class I binding site in human IgG through the use of recombinant IgG1/IgG2 hybrid and point-mutated antibodies," PNAS, USA, 88:9036-9040 (Oct. 1991).

Miranda-Carus et al., IL-15 and the initiation of cell contact-dependent synovial fibroblast-T lymphocyte cross-talk in rheumatoid arthritis: effect of methotrexate., 2004 J. Immunol. 13:1463-1476.

Koka et al, Cutting edge: murine dendritic cells require IL-15R alpha to prime NK cells., 2004 J. Immunol. 173:3594-3598.

Matsumoto et al., On-column refolding and characterization of soluble human interleukin-15 receptor alpha-chain produced in *Escherichia coli.*, Protein Purification and Expression, 2003 64-71.

Ha et al., Immunoglobulin Fc Heterodimer Platform Technology: From Design to Applications in Therapeutic Antibodies and Proteins., Front Immunol. 2016; 7: 394. Published online Oct. 6, 2016. doi: 10.3389/fimmu.2016.00394.

Rhode et al., Comparison of the Superagonist Complex, ALT-803, to IL15 as Cancer Immunotherapeutics in Animal Models., Cancer Immunol Res. Jan. 2016;4(1):49-60. doi: 10.1158/2326-6066.CIR-15-0093-T. Epub Oct. 28, 2015.

Steinbacher et al., An Fc-optimized NKG2D-immunoglobulin G Fusion Protein for Induction of Natural Killer Cell Reactivity Against Leukemia., Int J Cancer. Mar. 1, 2015;136(5):1073-84. doi: 10.1002/ijc.29083. Epub Jul. 28, 2014.

(56) References Cited

OTHER PUBLICATIONS

Prajapati et al., Functions of NKG2D in CD8 + T Cells: An Opportunity for Immunotherapy., Cell Mol Immunol. May 2018;15(5):470-479. doi: 10.1038/cmi.2017.161. Epub Feb. 5, 2018.

Fabbi et al, Dual Roles of IL-15 in Cancer Biology, Journal of Cytokine Biology, 2016, vol. 1, No. 2, pp. 1-7.

Mathios et al, Therapeutic administration of IL-15 superagonist complex ALT-803 leads to long-term survival and durable antitumor immune response in a murine glioblastoma model., International Journal of Cancer, 2016; vol. 138, pp. 187-194.

Alter et al., Targeted IL-15-based Protein Fusion Complexes as Cancer Immunotherapy Approaches., J Immunological Sci. (2018); 2(1): 15-18.

Bailey et al., New interleukin-15 superagonist (IL-15SA) significantly enhances graft-versus-tumor activity., Oncotarget. Jul. 4, 2017; 8(27): 44366-44378.

Charych et al., NKTR-214, an Engineered Cytokine with Biased IL2 Receptor Binding, Increased Tumor Exposure, and Marked Efficacy in Mouse Tumor Models., Clin Cancer Res; 22(3) Feb. 1, 2016.

Chen et al., A targeted IL-15 fusion protein with potent antitumor activity., (2015) Cancer Biology & Therapy, 16:9, 1415-1421, DOI: 10.1080/15384047.2015.1071739.

Ghasemi et al., Selective targeting of IL-2 to NKG2D bearing cells for improved immunotherapy., Nature Communications vol. 7, Article No. 12878 (2016).

Jochems et al., The multi-functionality of N-809, a novel fusion protein encompassing anti-PD-L1 and the IL-15 superagonist fusion complex., OncoImmunology, 2019, vol. 8, No. 2, e1532764 (15 pages).

Klein et al., Cergutuzumab amunaleukin (CEA-IL2v), a CEAtargeted IL-2 variant-based immunocytokine for combination cancer immunotherapy: Overcoming limitations of aldesleukin and conventional IL-2-based immunocytokines.,(2017) OncoImmunology, 6:3, e1277306, DOI: 10.1080/2162402X.2016.1277306.

Olsen et al., Crystal Structure of the Interleukin-15 * Interleukin-15 Receptor α Complex., The Journal of Biological Chemistry vol. 282, No. 51, pp. 37191-37204, Dec. 21, 2007.

Vallera et al., IL15 Trispecific Killer Engagers (TriKE) Make Natural Killer Cells Specific to CD33b Targets While Also Inducing Persistence, In Vivo Expansion, and Enhanced Function., Clin Cancer Res; 22(14) Jul. 15, 2016.

Xu et al., Efficacy and Mechanism-of-Action of a Novel Superagonist Interleukin-15: Interleukin-15 Receptor α Su/Fc Fusion Complex in Syngeneic Murine Models of Multiple Myeloma., Cancer Res; 73(10) May 15, 2013.

* cited by examiner

Figure 1A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 1B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 1C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 1D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 1E

| Monomer 1 | Monomer 2 |
|---|---|
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| K247Q/R355Q/N384S/K392N/V397M/Q419E/K447_ | P217R/P228R/N276K |
| K247Q/R355Q/N384S/K392N/V397M/Q419E/K447_ | N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| K247Q/R355Q/Q419E/K447_ | P217R/P228R/N276K |
| K247Q/R355Q/Q419E/K447_ | N276K |
| I199T/N203D/K274Q/R355Q/N384S/K392N/V397M/Q419E/K447_ | |
| N208D/Q295E/N384D/Q418E/N421D | |
| N208D/Q295E/Q418E/N421D | |
| Q196K/I199T/P217R/P228R/N276K | |
| Q196K/I199T/N276K | |
| K274Q/R355Q/N384S/K392N/V397M/Q419E/K447_ | |
| Q295E/N384D/Q418E/N421D | |
| Q295E/Q418E/N421D | |
| P217R/P228R/N276K | |
| N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 2

| Variant constant region | Substitutions |
|---|---|
| pI_ISO(-) | I199T/N203D/K274Q/R355Q/N384S/K392N/V397M/Q419E/K447_ |
| pI_ISO(-)-Fc only | K274Q/R355Q/N384S/K392N/V397M/Q419E/K447_ |
| pI_(-)_isosteric A | N208D/Q295E/N384D/Q418E/N421D |
| pI_(-)_isosteric A-Fc only | Q295E/N384D/Q418E/N421D |
| pI_(-)_isosteric_B | N208D/Q295E/Q418E/N421D |
| pI_(-)_isosteric_B-Fc only | Q295E/Q418E/N421D |
| pI_ISO(+RR) | Q196K/I199T/P217R/P228R/N276K |
| pI_ISO(+RR)-Fc only | P217R/P228R/N276K |
| pI_ISO(+) | Q196K/I199T/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 3

Ablation Variants
G236R
S239G
S239K
S239Q
S239R
V266D
S267K
S267R
H268K
E269R
299R
299K
K322A
A327G
A327L
A327N
A327Q
L328E
P329K
A330L
A330S/P331S
I332K
I332R
V266D/A327Q
V266D/P329K
S267R/A327Q
S267R/P329K
G236R/L328R
E233P/L234V/L235A/G236_/S239K
E233P/L234V/L235A/G236_/S267K
E233P/L234V/L235A/G236_/S239K/A327G
E233P/L234V/L235A/G236_/S267K/A327G
E233P/L234V/L235A/G236_
S239K/S267K
267K/P329K

Figure 4A

| IL-15-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 4B

| scIL-15/Rα-Fc monomer (-) | empty-Fc monomer (+) |
|---|---|
| C220S | C220S |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 4C

| empty-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 4D

| IL-15Rα(sushi)-Fc Chain 1 | IL-15Rα(sushi)-Fc Chain 2 |
|---|---|
| C220S | C220S |
| FcKO | FcKO |
| ±M428L/N434S | ±M428L/N434S |

Figure 4E

| Fc-IL-15Rα(sushi) (-) | IL-15Rα(sushi)-Fc monomer (+) |
|---|---|
| C220S | C220S |
| Heterodimer pI variants L368D/K370S | Heterodimer pI variants S364K/E357Q |
| | Isosteric pI substitutions P217R/P228R/N276K |
| FcKO | FcKO |
| ±M428L/N434S | ±M428L/N434S |

Figure 5A

| scIL-15/Rα-Fc monomer (-) | scFv-Fc monomer (+) |
|---|---|
| C220S | C220S |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 5B

| scFv-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 5C

| scIL-15/Rα-Fc monomer (-) | Heavy Chain (+) |
|---|---|
| C220S | |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 5D

| Heavy Chain (-) | IL-15Rα(sushi)-Fc monomer (+) |
|---|---|
| | C220S |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 5E

| Heavy Chain-IL-15Rα(sushi) (-) | Heavy Chain (+) |
|---|---|
| Heterodimer pI variants L368D/K370S | Heterodimer pI variants S364K/E357Q |
| Isosteric pI substitutions | Isosteric pI subsitutions |
| FcKO | FcKO |
| ±M428L/N434S | ±M428L/N434S |

Figure 5F

| Heavy Chain (-) | Heavy Chain-IL-15Rα(sushi) (+) |
|---|---|
| Heterodimer pI variants L368D/K370S | Heterodimer pI variants S364K/E357Q |
| Isosteric pI substitutions | Isosteric pI subsitutions |
| FcKO | FcKO |
| ±M428L/N434S | ±M428L/N434S |

Figure 6

| Name | Sequence | SEQ ID NO: |
|---|---|---|
| (GGGGS)$_1$ or GGGGS | GGGGS | 11 |
| (GGGGS)$_2$ | GGGGSGGGGS | 12 |
| (GGGGS)$_3$ | GGGGSGGGGSGGGGS | 13 |
| (GGGGS)$_4$ | GGGGSGGGGSGGGGSGGGGS | 14 |
| (GGGGS)$_5$ | GGGGSGGGGSGGGGSGGGGSGGGGS | 15 |
| (GGGGS)$_6$ | GGGGSGGGGSGGGGSGGGGSGGGGSGGGGS | 16 |
| (GGGGS)$_7$ | GGGGSGGGGSGGGGSGGGGSGGGGSGGGGSGGGGS | 17 |
| 30AA-linker | DPALVHQRPAPPGGGSGGGGSGGGGSGGG | 18 |
| (GKPGS)$_1$ or GKPGS | GKPGS | 19 |
| (GKPGS)$_5$ | GKPGSGKPGSGKPGSGKPGSGKPGS | 20 |
| (GKPGS)$_6$ | GKPGSGKPGSGKPGSGKPGSGKPGSGKPGS | 21 |
| (GGGES)$_1$ or GGGES | GGGES | 22 |

Figure 7

Positive Charged scFv Linkers

| Name | Sequence | Length | Charge | SEQ ID NO: |
| --- | --- | --- | --- | --- |
| Gly-Ser 15 | GGGGSGGGGSGGGGS | 15 | 0 | 13 |
| Whitlow linker | GSTSGSGKPGSGEGSTKG | 18 | +1 | 23 |
| 6paxA_1 (+A) | IRPRAIGGSKPRVA | 14 | +4 | 24 |
| +B | GKGGSGKGGSGKGGS | 15 | +3 | 25 |
| +C | GGKGSGGKGSGGKGS | 15 | +3 | 26 |
| +D | GGGKSGGGKSGGGKS | 15 | +3 | 27 |
| +E | GKGKSGKGKSGKGKS | 15 | +6 | 28 |
| +F | GGGKSGGKGSGKGGS | 15 | +3 | 29 |
| +G | GKPGSGKPGSGKPGS | 15 | +3 | 30 |
| +H | GKPGSGKPGSGKPGSGKPGS | 20 | +4 | 31 |
| +I | GKGKSGKGKSGKGKSGKGKS | 20 | +8 | 32 |

Negative Charged scFv Linkers

| Name | Sequence | Length | Charge | SEQ ID NO: |
| --- | --- | --- | --- | --- |
| Gly-Ser 20 | GGGGSGGGGSGGGGSGGGGS | 20 | 0 | 14 |
| 3hsc_2 (-A) | STAGDTHLGGEDFD | 14 | -4 | 33 |
| -B | GEGGSGEGGSGEGGS | 15 | -3 | 34 |
| -C | GGEGSGGEGSGGEGS | 15 | -3 | 35 |
| -D | GGGESGGGESGGGES | 15 | -3 | 36 |
| -E | GEGESGEGESGEGES | 15 | -6 | 37 |
| -F | GGGESGGEGSGEGGS | 15 | -3 | 38 |
| -G | GEGESGEGESGEGESGEGES | 20 | -8 | 39 |

Additional scFv Linkers

| Sequence | SEQ ID NO: |
| --- | --- |
| GGGGSGGGGSGGGGS | SEQ ID NO: 13 |
| GGGGSGGGGSGGGGSGGGGS | SEQ ID NO: 14 |
| GSTSGSGKPGSGEGSTKG | SEQ ID NO: 23 |
| PRGASKSGSASQTGSAPGS | SEQ ID NO: 40 |
| GTAAAGAGAAGGAAAGAAG | SEQ ID NO: 41 |
| GTSGSSGSGSGGSGSGGGG | SEQ ID NO: 42 |
| GKPGSGKPGSGKPGSGKPGS | SEQ ID NO: 31 |

Figure 8A

IL-15/Rα-Fc Backbone 1

>IL-15/Rα-Fc monomer 1 (SEQ ID NO: 43)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO: 44)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 2

>IL-15/Rα-Fc monomer 1 (SEQ ID NO: 45)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO: 46)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 3

>IL-15/Rα-Fc monomer 1 (SEQ ID NO: 47)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO: 48)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CEVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 4

>IL-15/Rα-Fc monomer 1 (SEQ ID NO: 49)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSKGSFFLYSKLTVDKSRWQQGNVFSCSVMHEALHNHYTQKSL
SLSPGK >IL-15/Rα-Fc monomer 2 (SEQ ID NO: 50)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTENEVSLT
CLVKGFYPSDIAVEWESDGQPENNYKTTPPVLDSDGSFFLYSKLEVDKSRWEQGDVFSCSVMHEALHNHYTQKSL
SLSPGK

Figure 8B

<u>IL-15/Rα-Fc Backbone 5</u>

>IL-15/Rα-Fc monomer 1 (SEQ ID NO: 51)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSRDQLTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>IL-15/Rα-Fc monomer 2 (SEQ ID NO: 52)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSRDELTKNQVSLT
CDVSGFYPSDIAVEWESDGQPENNYKTTPPVLDSDGSFFLYSKLTVDKSRWEQGDVFSCSVMHEALHNHYTQKSL
SLSPGK <u>IL-15/Rα-Fc Backbone 6</u>

>IL-15/Rα-Fc monomer 1 (SEQ ID NO: 53)
EPKSSDKTHTCPPCPAPPVAGPSVFLFPPKPKDTLMISRTPEVTCVVVDVKHEDPEVKFNWYVDGVEVHNAKTKP
REEQYASTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>IL-15/Rα-Fc monomer 2 (SEQ ID NO: 54)
EPKSSDKTHTCPPCPAPPVAGPSVFLFPPKPKDTLMISRTPEVTCVVVDVKHEDPEVKFNWYVDGVEVHNAKTKP
REEEYASTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK <u>IL-15/Rα-Fc Backbone 7</u>

>IL-15/Rα-Fc monomer 1 (SEQ ID NO: 55)
EPKSSDKTHTCPPCPAPPVAGPSVFLFPPKPKDTLMISRTPEVTCVVVDVKHEDPEVKFNWYVDGVEVHNAKTKP
REEQYSSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>IL-15/Rα-Fc monomer 2 (SEQ ID NO: 56)
EPKSSDKTHTCPPCPAPPVAGPSVFLFPPKPKDTLMISRTPEVTCVVVDVKHEDPEVKFNWYVDGVEVHNAKTKP
REEEYSSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK <u>IL-15/Rα-Fc Backbone 8</u>

>IL-15/Rα-Fc monomer 1 (SEQ ID NO: 57)
ESKYGPPCPPCPAPEFLGGPSVFLFPPKPKDTLMISRTPEVTCVVVDVSQEDPEVQFNWYVDGVEVHNAKTKPRE
EQFNSTYRVVSVLTVLHQDWLNGKEYKCKVSNKGLPSSIEKTISKAKGQPREPQVYTLPPSQEQMTKNQVKLTCL
VKGFYPSDIAVEWESNGQPENNYKTTPPVLDSDGSFFLYSRLTVDKSRWQEGNVFSCSVMHEALHNHYTQKSLSL
SLGK

>IL-15/Rα-Fc monomer 2 (SEQ ID NO: 58)
ESKYGPPCPPCPAPEFLGGPSVFLFPPKPKDTLMISRTPEVTCVVVDVSQEDPEVQFNWYVDGVEVHNAKTKPRE
EEFNSTYRVVSVLTVLHQDWLNGKEYKCKVSNKGLPSSIEKTISKAKGQPREPQVYTLPPSQEEMTKNQVSLTCD
VSGFYPSDIAVEWESDGQPENNYKTTPPVLDSDGSFFLYSRLTVDKSRWEEGDVFSCSVMHEALHNHYTQKSLSL
SLGK

Figure 8C

IL-15/Rα-Fc Backbone 9

>IL-15/Rα-Fc monomer 1 (SEQ ID NO: 59)
ERKCCVECPPCPAPPVAGPSVFLFPPKPKDTLMISRTPEVTCVVVDVSHEDPEVQFNWYVDGVEVHNAKTKPREE
QFNSTFRVVSVLTVVHQDWLNGKEYKCKVSNKGLPAPIEKTISKTKGQPREPQVYTLPPSREQMTKNQVKLTCLV
KGFYPSDIAVEWESNGQPENNYKTTPPMLDSDGSFFLYSKLTVDKSRWQQGNVFSCSVMHEALHNHYTQKSLSLS
PGK >IL-15/Rα-Fc monomer 2 (SEQ ID NO: 60)
ERKCCVECPPCPAPPVAGPSVFLFPPKPKDTLMISRTPEVTCVVVDVSHEDPEVQFNWYVDGVEVHNAKTKPREE
EFNSTFRVVSVLTVVHQDWLNGKEYKCKVSNKGLPAPIEKTISKTKGQPREPQVYTLPPSREEMTKNQVSLTCDV
SGFYPSDIAVEWESDGQPENNYKTTPPMLDSDGSFFLYSKLTVDKSRWEQGDVFSCSVMHEALHNHYTQKSLSLS
PGK

IL-15/Rα-Fc Backbone 10

>IL-15/Rα-Fc monomer 1 (SEQ ID NO: 61)
ERKCCVECPPCPAPPVAGPSVFLFPPKPKDTLMISRTPEVTCVVVDVKHEDPEVQFNWYVDGVEVHNAKTKPREE
QFNSTFRVVSVLTVVHQDWLNGKEYKCKVSNKGLPAPIEKTISKTKGQPREPQVYTLPPSREQMTKNQVKLTCLV
KGFYPSDIAVEWESNGQPENNYKTTPPMLDSDGSFFLYSKLTVDKSRWQQGNVFSCSVMHEALHNHYTQKSLSLS
PGK >IL-15/Rα-Fc monomer 2 (SEQ ID NO: 62)
ERKCCVECPPCPAPPVAGPSVFLFPPKPKDTLMISRTPEVTCVVVDVKHEDPEVQFNWYVDGVEVHNAKTKPREE
EFNSTFRVVSVLTVVHQDWLNGKEYKCKVSNKGLPAPIEKTISKTKGQPREPQVYTLPPSREEMTKNQVSLTCDV
SGFYPSDIAVEWESDGQPENNYKTTPPMLDSDGSFFLYSKLTVDKSRWEQGDVFSCSVMHEALHNHYTQKSLSLS
PGK

IL-15/Rα-Fc Backbone 11

>IL-15/Rα-Fc monomer 1 (SEQ ID NO: 63)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVLHEALHSHYTQKSL
SLSPGK >IL-15/Rα-Fc monomer 2 (SEQ ID NO: 64)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVLHEALHSHYTQKSL
SLSPGK

IL-15/Rα-Fc Backbone 12

>IL-15/Rα-Fc monomer 1 (SEQ ID NO: 65)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO: 66)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQKSL
SLSPGK

Figure 8D

<u>IL-15/Rα-Fc Backbone 13</u>

>IL-15/Rα-Fc monomer 1 (SEQ ID NO: 67)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK >IL-15/Rα-Fc monomer 2 (SEQ ID NO: 68)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 9

IL-15/Rα x anti-CD8 Backbone 1

Chain 1 (SEQ ID NO: 69)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
NTKVDKKVEPKSCDKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPSDIAVEWESNGQPE
NNYKTTPPVLDSDGSFFLYSKLTVDKSRWQQGNVFSCSVMHEALHNHYTQKSLSLSPGK Chain 2 (SEQ ID NO: 70)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK

IL-15/Rα x anti-CD8 Backbone 2

Chain 1 (SEQ ID NO: 71)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
DTKVDKKVEPKSCDKTHTCPPCPAPPVAGPSVFLFPPKPKDTLMISRTPEVTCVVVDVKHEDPEVKFNWYVDGVEVHNAKTKPREEEYNS
TYRVVSVLTVLHQDWLNGKEYKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK Chain 2 (SEQ ID NO: 72)
EPKSSDKTHTCPPCPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWESNGQPENNYKTTPP
VLDSDGSFFLYSKLTVDKSRWQQGNVFSCSVMHEALHNHYTQKSLSLSPGK

IL-15/Rα x anti-CD8 Backbone 3

Chain 1 (SEQ ID NO: 73)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
DTKVDKKVEPKSCDKTHTCPPCPAPPVAGPSVFLFPPKPKDTLMISRTPEVTCVVVDVKHEDPEVKFNWYVDGVEVHNAKTKPREEEYNS
TYRVVSVLTVLHQDWLNGKEYKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK Chain 2 (SEQ ID NO: 74)
ASTKGPSVFPLAPSSKSTSGGTAALGCLVKDYFPEPVTVSWNSGALTSGVHTFPAVLQSSGLYSLSSVVTVPSSSLGTKTYTICNVNHKPS
NTKVDKKVERKSCDKTHTCPRCPAPPVAGPSVFLFPPKPKDTLMISRTPEVTCVVVDVKHEDPEVKFKWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPSDIAVEWESNGQPE
NNYKTTPPVLDSDGSFFLYSKLTVDKSRWQQGNVFSCSVMHEALHNHYTQKSLSLSPGK

Figure 10

Constant Light Chain – Kappa (SEQ ID NO: 75)
RTVAAPSVFIFPPSDEQLKSGTASVVCLLNNFYPREAKVQWKVDNALQSGNSQESVTEQDSKDSTYSLSSTLTLSKADYEKHKVYACEVT
HQGLSSPVTKSFNRGEC

Constant Light Chain – Lambda (SEQ ID NO: 76)
GQPKAAPSVTLFPPSSEELQANKATLVCLISDFYPGAVTVAWKADSSPVKAGVETTTPSKQSNNKYAASSYLSLT
PEQWKSHRSYSCQVTHEGSTVEKTVAPTECS

Figure 11

>XENP15074 Numax_IgG1_PVA_/S267K

XENP15074 Heavy Chain (SEQ ID NOS 77-81)
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK

XENP15074 Light Chain (SEQ ID NOS 82-86)
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

Figure 12

>XENP16432 Nivolumab_H0L0_IgG1_PVA_/S267K

XENP16432 Heavy Chain (SEQ ID NOS 87-91)
QVQLVESGGGVVQPGRSLRLDCKASGITFSNSGMHWVRQAPGKGLEWVAVIWYDGSKRYYADSVKGRFTISRDNS
KNTLFLQMNSLRAEDTAVYYCATNDDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAV
EWESNGQPENNYKTTPPVLDSDGSFFLYSKLTVDKSRWQQGNVFSCSVMHEALHNHYTQKSLSLSPGK

XENP16432 Light Chain (SEQ ID NOS 92-96)
EIVLTQSPATLSLSPGERATLSCRASQSVSSYLAWYQQKPGQAPRLLIYDASNRATGIPARFSGSGSGTDFTLTI
SSLEPEDFAVYYCQQSSNWPRTFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 13

>XENP26007 human_IL15Ra(sushi)_(GGGGS)5-human_IL15(N4D/N65D;single-Chain
)-Numax_IgG1_Fc(216)_IgG1_pI(-)_Isosteric_A_C220S/PVA_/S267K/L368D/K370S-
IgG1_PVA_/S267K/S364K/E357Q Chain 1 - human_IL15Ra(sushi)_(GGGGS)5-human_IL15(N4D/N65D;single-Chain
)_Fc(216)_IgG1_pI(-)_Isosteric_A_C220S/PVA_/S267K/L368D/K370S (SEQ ID NOS 97-100)

ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - Numax_IgG1_PVA_/S267K/S364K/E357Q Heavy Chain (SEQ ID NOS 101-105)

QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK

Chain 3 - Numax Light Chain (SEQ ID NOS 106-110)

DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

Figure 15A

Human IL-15 precursor sequence

\>sp|P40933 (SEQ ID NO: 111)
MRISKPHLRSISIQCYLCLLLNSHFLTEAGIHVFILGCFSAGLPKTEANWVNVISDLKKIEDLIQSMHIDATLYT
ESDVHPSCKVTAMKCFLLELQVISLESGDASIHDTVENLIILANNSLSSNGNVTESGCKECEELEEKNIKEFLQS
FVHIVQMFINTS

Human IL-15 mature form sequence

\>sp|P40933|49-162 (SEQ ID NO: 112)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Human IL-15Rα sequence

\>sp|Q13261 (SEQ ID NO: 113)
MAPRRARGCRTLGLPALLLLLLLRPPATRGITCPPPMSVEHADIWVKSYSLYSRERYICNSGFKRKAGTSSLTEC
VLNKATNVAHWTTPSLKCIRDPALVHQRPAPPSTVTTAGVTPQPESLSPSGKEPAASSPSSNNTAATTAAIVPGS
QLMPSKSPSTGTTEISSHESSHGTPSQTTAKNWELTASASHQPPGVYPQGHSDTTVAISTSTVLLCGLSAVSLLA
CYLKSRQTPPLASVEMEAMEALPVTWGTSSRDEDLENCSHHL

Human IL-15Rα, extracellular domain

\>sp|Q13261|31-205 (SEQ ID NO: 114)
ITCPPPMSVEHADIWVKSYSLYSRERYICNSGFKRKAGTSSLTECVLNKATNVAHWTTPSLKCIRDPALVHQRPA
PPSTVTTAGVTPQPESLSPSGKEPAASSPSSNNTAATTAAIVPGSQLMPSKSPSTGTTEISSHESSHGTPSQTTA
KNWELTASASHQPPGVYPQGHSDTT

Human IL-15Rα, sushi domain

\>sp|Q13261|31-95 (SEQ ID NO: 115)
ITCPPPMSVEHADIWVKSYSLYSRERYICNSGFKRKAGTSSLTECVLNKATNVAHWTTPSLKCIR

Human IL-15Rß sequence

\>sp|P14784 (SEQ ID NO: 116)
MAAPALSWRLPLLILLLPLATSWASAAVNGTSQFTCFYNSRANISCVWSQDGALQDTSCQVHAWPDRRRWNQTCE
LLPVSQASWACNLILGAPDSQKLTTVDIVTLRVLCREGVRWRVMAIQDFKPFENLRLMAPISLQVVHVETHRCNI
SWEISQASHYFERHLEFEARTLSPGHTWEEAPLLTLKQKQEWICLETLTPDTQYEFQVRVKPLQGEFTTWSPWSQ
PLAFRTKPAALGKDTIPWLGHLLVGLSGAFGFIILVYLLINCRNTGPWLKKVLKCNTPDPSKFFSQLSSEHGGDV
QKWLSSPFPSSSFSPGGLAPEISPLEVLERDKVTQLLLQQDKVPEPASLSSNHSLTSCFTNQGYFFFHLPDALEI
EACQVYFTYDPYSEEDPDEGVAGAPTGSSPQPLQPLSGEDDAYCTFPSRDDLLLFSPSLLGGPSPPSTAPGGSGA
GEERMPPSLQERVPRDWDPQPLGPPTPGVPDLVDFQPPPELVLREAGEEVPDAGPREGVSFPWSRPPGQGEFRAL
NARLPLNTDAYLSLQELQGQDPTHLV

Human IL-15Rß, extracellular domain

\>sp|P14784|27-240 (SEQ ID NO: 117)
AVNGTSQFTCFYNSRANISCVWSQDGALQDTSCQVHAWPDRRRWNQTCELLPVSQASWACNLILGAPDSQKLTTV
DIVTLRVLCREGVRWRVMAIQDFKPFENLRLMAPISLQVVHVETHRCNISWEISQASHYFERHLEFEARTLSPGH
TWEEAPLLTLKQKQEWICLETLTPDTQYEFQVRVKPLQGEFTTWSPWSQPLAFRTKPAALGKDT

Figure 15B

Human common gamma chain sequence

>sp|P31785 (SEQ ID NO: 118)
MLKPSLPFTSLLFLQLPLLGVGLNTTILTPNGNEDTTADFFLTTMPTDSLSVSTLPLPEVQCFVFNVEYMNCTWN
SSSEPQPTNLTLHYWYKNSDNDKVQKCSHYLFSEEITSGCQLQKKEIHLYQTFVVQLQDPREPRRQATQMLKLQN
LVIPWAPENLTLHKLSESQLELNWNNRFLNHCLEHLVQYRTDWDHSWTEQSVDYRHKFSLPSVDGQKRYTFRVRS
RFNPLCGSAQHWSEWSHPIHWGSNTSKENPFLFALEAVVISVGSMGLIISLLCVYFWLERTMPRIPTLKNLEDLV
TEYHGNFSAWSGVSKGLAESLQPDYSERLCLVSEIPPKGGALGEGPGASPCNQHSPYWAPPCYTLKPET

Human common gamma chain, extracellular domain

>sp|P31785|23-262 (SEQ ID NO: 119)
LNTTILTPNGNEDTTADFFLTTMPTDSLSVSTLPLPEVQCFVFNVEYMNCTWNSSSEPQPTNLTLHYWYKNSDND
KVQKCSHYLFSEEITSGCQLQKKEIHLYQTFVVQLQDPREPRRQATQMLKLQNLVIPWAPENLTLHKLSESQLEL
NWNNRFLNHCLEHLVQYRTDWDHSWTEQSVDYRHKFSLPSVDGQKRYTFRVRSRFNPLCGSAQHWSEWSHPIHWG
SNTSKENPFLFALEA

Figure 16A-Figure 16D
Figure 16A
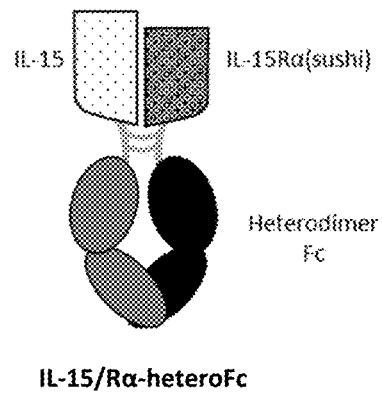
IL-15/Rα-heteroFc
Example: XENP20818
Figure 16B
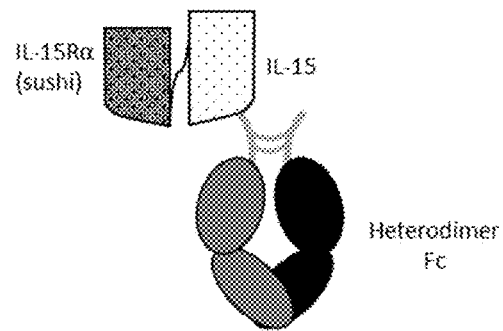
scIL-15/Rα-Fc
Example: XENP21478
Figure 16C
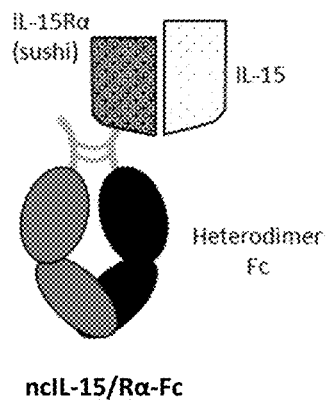
ncIL-15/Rα-Fc
Example: XENP21479
Figure 16D
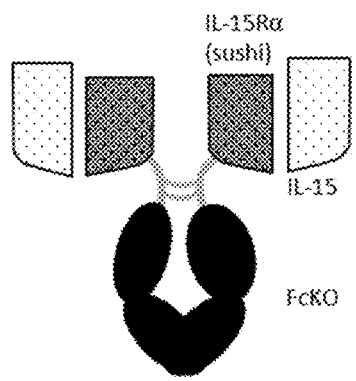
Bivalent ncIL-15/Rα-Fc
Example: XENP21978

Figure 16E-Figure 16G
Figure 16E
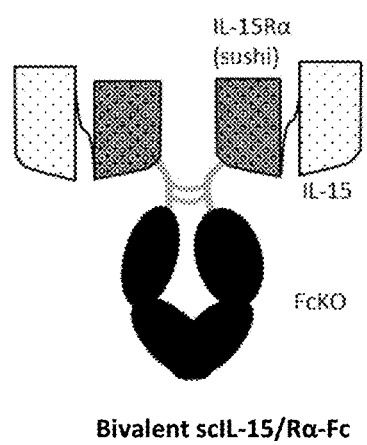
Bivalent scIL-15/Rα-Fc
Figure 16F
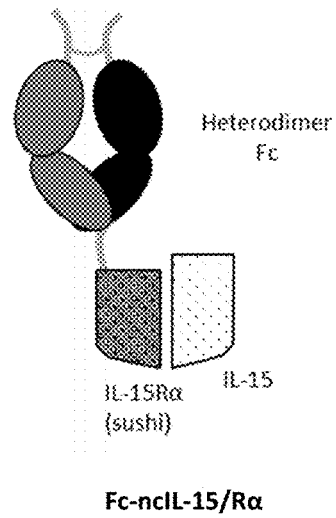
Fc-ncIL-15/Rα
Example: XENP22637
Figure 16G
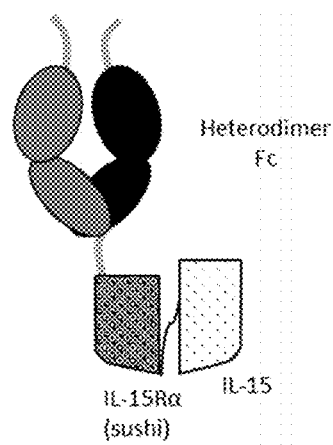
Fc-scIL-15/Rα

Figure 17

>XENP20818 – human IL15-(GGGGS)₁ x human IL15Rα(Sushi)-(GGGGS)₁ Fc heterodimer

Chain 1 - human_IL15_(GGGGS)₁_Fc(216)_IgG1_pI(-)_Isosteric_A_C220S/PVA_/S267K/L368D/K370S (SEQ ID NOS 120-122)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_C220S/PVA_/S267K/S364K/E357Q (SEQ ID NOS 123-125)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP21475 – human IL15 x human IL15Rα(Sushi) Fc heterodimer Chain 1 - human_IL15-Fc(216)_IgG1_pI(-)_Isosteric_A_C220S/PVA_/S267K/L368D/K370S (SEQ ID NOS 126-128)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 - human_IL15Rα(Sushi)-Fc(216)_IgG1_C220S/PVA_/S267K/S364K/E357Q (SEQ ID NOS 129-131)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 18

>XENP21478 – human IL15Rα(Sushi)-(GGGGS)₆-human IL15(single-chain) Fc heterodimer

Chain 1 - human_IL15Rα(sushi)_(GGGGS)₆-human_IL15-Fc(216)_IgG1_pI(-)_Isosteric_A_C220S/PVA_/S267K/L368D/K370S (SEQ ID NOS 132-135)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVQMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK

Chain 2 - empty-Fc(216)_IgG1_C220S/PVA_/S267K/S364K/E357Q (SEQ ID NO: 136)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP21993 human_IL15Ra(sushi)_(GGGGS)5-human_IL15(single-Chain
)-empty-Fc_Fc(216)_IgG1_pI(-)_Isosteric_A_C220S/PVA_/S267K/L368D/K370S-
Fc(216)_IgG1_C220S/PVA_/S267K/S364K/E357Q

Chain 1 - human_IL15Ra(sushi)_(GGGGS)5-human_IL15(single-Chain)_Fc(216)_IgG1_pI(-)_Isosteric_A_C220S/PVA_/S267K/L368D/K370S scIL-15/Ra-Fc Chain (SEQ ID NOS 137-140)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - empty_Fc(216)_IgG1_C220S/PVA_/S267K/S364K/E357Q Chain (SEQ ID NO: 141)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP24013 human_IL15Ra(sushi)_(GGGGS)5-human_IL15(D61N;single-Chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(D61N;single-Chain)_Fc(216)_IgG1_pI(-)_Isosteric_A_C220S/PVA_/S267K/L368D/K370S (SEQ ID NOS 142-145)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHNTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - empty-Fc(216)_IgG1_C220S/PVA_/S267K/S364K/E357Q (SEQ ID NO: 146)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 19A

>XENP21479 – empty-Fc-IL15(non-covalent)-human_IL15Rα(Sushi) Fc heterodimer

Chain 1 - human_IL15_no_tag (SEQ ID NO: 147)
<u>NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS</u>

Chain 2 - empty-Fc(216)_IgG1_pI(-)_Isosteric_A_C220S/PVA_/S267K/L368D/K370S (SEQ ID NO: 148)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Rα(Sushi)-Fc(216)_IgG1_C220S/PVA_/S267K/S364K/E357Q (SEQ ID NOS 149-151)
<u>ITCPPPMSVEHADIWVKSYSLYSRERYICNSGFKRKAGTSSLTECVLNKATNVAHWTTPSLKCIR</u>/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

**>XENP022366 – empty-Fc-IL15(non-covalent)-human_IL15Ra(sushi)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q**

Chain 1 - human_IL15_no_tag (SEQ ID NO: 152)
<u>NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS</u>

Chain 2 - empty-Fc(216)_IgG1_pI(-)_Isosteric_A_C220S/PVA_/S267K/L368D/K370S (SEQ ID NO: 153)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi)_(GGGGS)1_Fc(216)_IgG1_C220S/PVA_/S267K/S364K/E357Q (SEQ ID NOS 154-156)
<u>ITCPPPMSVEHADIWVKSYSLYSRERYICNSGFKRKAGTSSLTECVLNKATNVAHWTTPSLKCIR</u>/<u>GGGGS</u>/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 19B

>XENP024348 IL15(non-covalent)-human_IL15Ra(Sushi)_empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 – IL15 WT (SEQ ID NO: 157)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Chain 2 – human_IL15Ra(Sushi)_Fc(216)_IgG1_pI(-)_Isosteric_A_C220S/PVA_/S267K/L368D/K370S (SEQ ID NOS 158-160)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 3 – empty_Fc(216)_IgG1_C220S/PVA_/S267K/S364K/E357Q (SEQ ID NO: 161)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 20

<u>>XENP021978 – human_IL15(non-covalent)-human_IL15Ra(Sushi)_Fc(216)_IgG1_C220S/PVA_/S267K</u>

Chain 1 - human_IL15Ra(Sushi)-Fc(216)_IgG1_C220S/PVA_/S267K (SEQ ID NOS 162-164)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Chain 2 - human_IL15_no_tag (SEQ ID NO: 165)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Figure 21 human_IL15(single-chain)-human_IL15Ra(Sushi)_Fc(216)_IgG1_C220S/PVA_/S267K (SEQ ID NOS 166-169)

NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/ITCPPPMSVEHADIWVKSYSLYSRERYIC
NSGFKRKAGTSSLTECVLNKATNVAHWTTPSLKCIR/EPKSSDKTHTCPPCPAPPVAGPSVFLFPPKPKDTLMIS
RTPEVTCVVVDVKHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK

Figure 22

>XENP022637 – empty-Fc(216)_IgG1_pI(-)_Isosteric_A_C220S/PVA_/S267K/L368D/K370S_(GGGGS)2_IL15Ra(Sushi)_IL15(non-covalent)_IgG1_ISO(+RR)_C220S/PVA_/S267K/S364K/E357Q

Chain 1 - empty-Fc(216)_IgG1_pI(-)_Isosteric_A_C220S/PVA_/S267K/L368D/K370S_(GGGGS)2_IL15Ra(Sushi) (SEQ ID NOS 170-172)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIR

Chain 2 - empty-Fc(216)_IgG1_ISO(+RR)_C220S/PVA_/S267K/S364K/E357Q (SEQ ID NO: 173)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Chain 3 - human_IL15_no_tag (SEQ ID NO: 174)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

>XENP022638 - empty-Fc(216)_IgG1_pI(-)_Isosteric_A_C220S/PVA_/S267K/L368D/K370S_IgG1_ISO(+RR)_C220S/PVA_/S267K/S364K/E357Q_(GGGGS)2_IL15Rα(Sushi)_IL15(non-covalent)

Chain 1 - empty-Fc(216)_IgG1_pI(-)_Isosteric_A_C220S/PVA_/S267K/L368D/K370S (SEQ ID NO: 175)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK

Chain 2 - empty-Fc(216)_IgG1_ISO(+RR)_C220S/PVA_/S267K/S364K/E357Q_(GGGGS)2_IL15Rα(Sushi) (SEQ ID NOS 176-178)
ERKSSDKTHTCPRCPAPPVAGPSVFLFPPKPKDTLMISRTPEVTCVVVDVKHEDPEVKFKWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWESNGQPENNYKTTPP
VLDSDGSFFLYSKLTVDKSRWQQGNVFSCSVMHEALHNHYTQKSLSLSPGK/GGGGSGGGGS/ITCPPPMSVEHADIWVKSYSLYSRERY
ICNSGFKRKAGTSSLTECVLNKATNVAHWTTPSLKCIR

Chain 3 – human_IL15 (SEQ ID NO: 179)
NWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

Figure 23 empty-Fc(216)_IgG1_pI(-
)_Isosteric_A_C220S/PVA_/S267K/L368D/K370S_(GGGGS)2_IL15Ra(Sushi)_IL15(single-
chain)_IgG1_ISO(+RR)_C220S/PVA_/S267K/S364K/E357Q

**Chain 1 - empty-Fc(216)_IgG1_pI(-
)_Isosteric_A_C220S/PVA_/S267K/L368D/K370S_(GGGGS)2_IL15Ra(Sushi)_IL15(single-chain)** (SEQ ID NOS 180-183)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIR/GGGGS/NWVNVISDLKKIEDLIQSMHIDATLYTESDVHPSCKVTAMKCFLLELQVISLESGDASIH
DTVENLIILANNSLSSNGNVTESGCKECEELEEKNIKEFLQSFVHIVQMFINTS

Chain 2 - empty-Fc(216)_IgG1_ISO(+RR)_C220S/PVA_/S267K/S364K/E357Q (8927) (SEQ ID NO: 184)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 27

IL-15Rα(sushi-D96) (SEQ ID NO: 185)
ITCPPPMSVEHADIWVKSYSLYSRERYICNSGFKRKAGTSSLTECVLNKATNVAHWTTPSLKCIRD

IL-15Rα(sushi-D96/P97) (SEQ ID NO: 186)
ITCPPPMSVEHADIWVKSYSLYSRERYICNSGFKRKAGTSSLTECVLNKATNVAHWTTPSLKCIRDP

IL-15Rα(sushi-D96/P97/A98) (SEQ ID NO: 187)
ITCPPPMSVEHADIWVKSYSLYSRERYICNSGFKRKAGTSSLTECVLNKATNVAHWTTPSLKCIRDPA

Figure 28

IL-15(E87C) (SEQ ID NO: 188)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

IL-15(V49C) (SEQ ID NO: 189)
NWVNVISDLKKIEDLIQSMHIDATLYTESDVHPSCKVTAMKCFLLELQCISLESGDASIHDTVENLIILANNSLS
SNGNVTESGCKECEELEEKNIKEFLQSFVHIVQMFINTS

IL-15(L52C) (SEQ ID NO: 190)
NWVNVISDLKKIEDLIQSMHIDATLYTESDVHPSCKVTAMKCFLLELQVISCESGDASIHDTVENLIILANNSLS
SNGNVTESGCKECEELEEKNIKEFLQSFVHIVQMFINTS

IL-15(E89C) (SEQ ID NO: 191)
NWVNVISDLKKIEDLIQSMHIDATLYTESDVHPSCKVTAMKCFLLELQVISLESGDASIHDTVENLIILANNSLS
SNGNVTESGCKECCELEEKNIKEFLQSFVHIVQMFINTS

IL-15(Q48C) (SEQ ID NO: 192)
NWVNVISDLKKIEDLIQSMHIDATLYTESDVHPSCKVTAMKCFLLELCVISLESGDASIHDTVENLIILANNSLS
SNGNVTESGCKECEELEEKNIKEFLQSFVHIVQMFINTS

IL-15(E53C) (SEQ ID NO: 193)
NWVNVISDLKKIEDLIQSMHIDATLYTESDVHPSCKVTAMKCFLLELQVISLCSGDASIHDTVENLIILANNSLS
SNGNVTESGCKECEELEEKNIKEFLQSFVHIVQMFINTS

IL-15(C42S) (SEQ ID NO: 194)
NWVNVISDLKKIEDLIQSMHIDATLYTESDVHPSCKVTAMKSFLLELQVISLESGDASIHDTVENLIILANNSLS
SNGNVTESGCKECEELEEKNIKEFLQSFVHIVQMFINTS

IL-15(L45C) (SEQ ID NO: 195)
NWVNVISDLKKIEDLIQSMHIDATLYTESDVHPSCKVTAMKCFLCELQVISLESGDASIHDTVENLIILANNSLS
SNGNVTESGCKECEELEEKNIKEFLQSFVHIVQMFINTS

Figure 29

IL-15Rα(sushi-D96/C97) (SEQ ID NO: 196)
ITCPPPMSVEHADIWVKSYSLYSRERYICNSGFKRKAGTSSLTECVLNKATNVAHWTTPSLKCIRDC

IL-15Rα(sushi-D96/P97/C98) (SEQ ID NO: 197)
ITCPPPMSVEHADIWVKSYSLYSRERYICNSGFKRKAGTSSLTECVLNKATNVAHWTTPSLKCIRDPC

IL-15Rα(sushi-D96/C97/A98) (SEQ ID NO: 198)
ITCPPPMSVEHADIWVKSYSLYSRERYICNSGFKRKAGTSSLTECVLNKATNVAHWTTPSLKCIRDCA

IL-15Rα(sushi-S40C) (SEQ ID NO: 199)
ITCPPPMSVEHADIWVKSYSLYSRERYICNSGFKRKAGTCSLTECVLNKATNVAHWTTPSLKCIR

IL-15Rα(sushi-K34C) (SEQ ID NO: 200)
ITCPPPMSVEHADIWVKSYSLYSRERYICNSGFCRKAGTSSLTECVLNKATNVAHWTTPSLKCIR

IL-15Rα(sushi-G38C) (SEQ ID NO: 201)
ITCPPPMSVEHADIWVKSYSLYSRERYICNSGFKRKACTSSLTECVLNKATNVAHWTTPSLKCIR

IL-15Rα(sushi-L42C) (SEQ ID NO: 202)
ITCPPPMSVEHADIWVKSYSLYSRERYICNSGFKRKAGTSSCTECVLNKATNVAHWTTPSLKCIR

IL-15Rα(sushi-A37C) (SEQ ID NO: 203)
ITCPPPMSVEHADIWVKSYSLYSRERYICNSGFKRKCGTSSLTECVLNKATNVAHWTTPSLKCIR Figure 30A-30D
Figure 30A
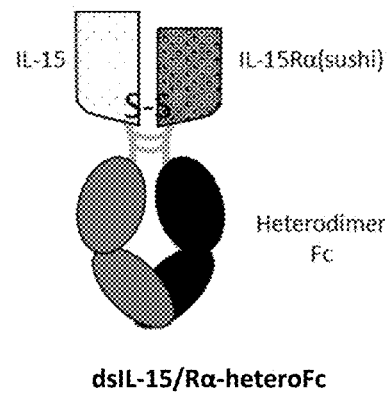
dsIL-15/Rα-heteroFc
Example: XENP22013
Figure 30B
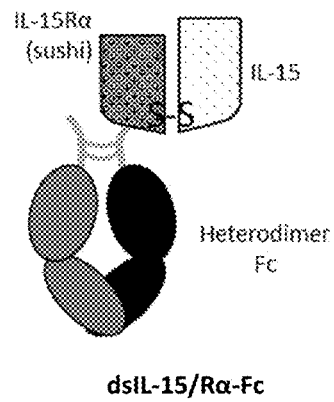
dsIL-15/Rα-Fc
Example: XENP22357
Figure 30C
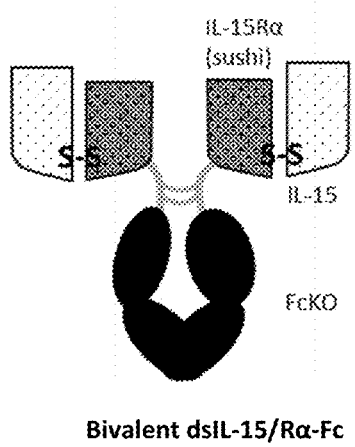
Bivalent dsIL-15/Rα-Fc
Example: XENP22634
Figure 30D
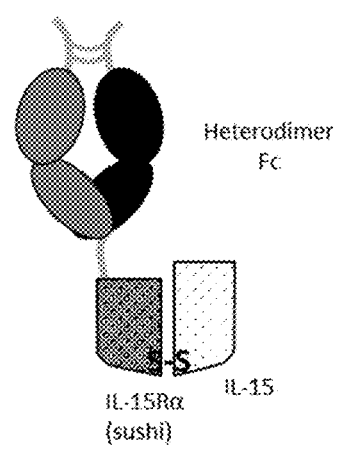
Fc-dsIL-15/Rα
Example: XENP22639

Figure 31A

>XENP022013 human_IL15_E87C_(GGGGS)1-human_IL15Ra(Sushi-D96/C97)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E87C_(GGGGS)1_Fc(216)_IgG1_pI(-)_Isosteric_A_C220S/PVA_/S267K/L368D/K370S
(SEQ ID NOS 204-206)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK Chain 2 - human_IL15Ra(Sushi-D96/C97)_(GGGGS)1_Fc(216)_IgG1_C220S/PVA_/S267K/S364K/E357Q (SEQ
ID NOS 207-209)
ITCPPPMSVEHADIWVKSYSLYSRERYICNSGFKRKAGTSSLTECVLNKATNVAHWTTPSLKCIRDC/GGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLTVLHQDWLNGKEYKCK
VSNKALPAPIEKTISKAKGQPREPQVYTLPPSREQMTKNQVKLTCLVKGFYPSDIAVEWESNGQPENNYKTTPPVLDSDGSFFLYSKLTV
DKSRWQQGNVFSCSVMHEALHNHYTQKSLSLSPGK >XENP022014 human_IL15_E87C_(GGGGS)1-human_IL15Ra(Sushi-D96/P97/C98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E87C_(GGGGS)1_Fc(216)_IgG1_pI(-)_Isosteric_A_C220S/PVA_/S267K/L368D/K370S
(SEQ ID NOS 210-212)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK Chain 2 - human_IL15Ra(Sushi-D96/P97/C98)_(GGGGS)1_Fc(216)_IgG1_C220S/PVA_/S267K/S364K/E357Q
(SEQ ID NOS 213-215)
ITCPPPMSVEHADIWVKSYSLYSRERYICNSGFKRKAGTSSLTECVLNKATNVAHWTTPSLKCIRDPC/GGGGS/EPKSSDKTHTCPPCP
APPVAGPSVFLFPPKPKDTLMISRTPEVTCVVVDVKHEDPEVKFNWYVDGVEVHNAKTKPREEQYNSTYRVVSVLTVLHQDWLNGKEYKC
KVSNKALPAPIEKTISKAKGQPREPQVYTLPPSREQMTKNQVKLTCLVKGFYPSDIAVEWESNGQPENNYKTTPPVLDSDGSFFLYSKLT
VDKSRWQQGNVFSCSVMHEALHNHYTQKSLSLSPGK >XENP022015 human_IL15_E87C_(GGGGS)1-human_IL15Ra(Sushi-D96/C97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E87C_(GGGGS)1_Fc(216)_IgG1_pI(-)_Isosteric_A_C220S/PVA_/S267K/L368D/K370S
(SEQ ID NOS 216-218)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK Chain 2 - human_IL15Ra(Sushi-D96/C97/A98)_(GGGGS)1_Fc(216)_IgG1_C220S/PVA_/S267K/S364K/E357Q
(SEQ ID NOS 219-221)
ITCPPPMSVEHADIWVKSYSLYSRERYICNSGFKRKAGTSSLTECVLNKATNVAHWTTPSLKCIRDCA/GGGGS/EPKSSDKTHTCPPCP
APPVAGPSVFLFPPKPKDTLMISRTPEVTCVVVDVKHEDPEVKFNWYVDGVEVHNAKTKPREEQYNSTYRVVSVLTVLHQDWLNGKEYKC
KVSNKALPAPIEKTISKAKGQPREPQVYTLPPSREQMTKNQVKLTCLVKGFYPSDIAVEWESNGQPENNYKTTPPVLDSDGSFFLYSKLT
VDKSRWQQGNVFSCSVMHEALHNHYTQKSLSLSPGK

Figure 31B

>XENP022017 human_IL15_L52C_(GGGGS)1-human_IL15Ra(Sushi-S40C)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 – human_IL15_L52C_(GGGGS)1-_Fc(216)_IgG1_pI(-)_Isosteric_A_C220S/PVA_/S267K/L368D/K370S (SEQ ID NOS 222-224)

NWVNVISDLKKIEDLIQSMHIDATLYTESDVHPSCKVTAMKCFLLELQVISCESGDASIHDTVENLIILANNSLSSNGNVTESGCKECEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK

Chain 2 – human_IL15Ra(Sushi-S40C)_(GGGGS)1_Fc(216)_IgG1_C220S/PVA_/S267K/S364K/E357Q (SEQ ID NOS 225-227)

ITCPPPMSVEHADIWVKSYSLYSRERYICNSGFKRKAGTCSLTECVLNKATNVAHWTTPSLKCIR/GGGGS/EPKSSDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDWLNGKEYKCKVS
NKALPAPIEKTISKAKGQPREPQVYTLPPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Figure 32A

>XENP022358 – empty-Fc-IL15_E87C-human_IL15Ra(Sushi-D96/P97/C98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_no_tag (SEQ ID NO: 228)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

Chain 2 - empty-Fc(216)_IgG1_pI(-)_Isosteric_A_C220S/PVA_/S267K/L368D/K370S (SEQ ID NO: 229)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-D96/P97/C98)_(GGGGS)1_Fc(216)_IgG1_C220S/PVA_/S267K/S364K/E357Q
(SEQ ID NOS 230-232)
ITCPPPMSVEHADIWVKSYSLYSRERYICNSGFKRKAGTSSLTECVLNKATNVAHWTTPSLKCIRDPC/GGGGS/
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP022359 – empty-Fc-IL15_E87C-human_IL15Ra(Sushi-D96/C97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_no_tag (SEQ ID NO: 233)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

Chain 2 - empty-Fc(216)_IgG1_pI(-)_Isosteric_A_C220S/PVA_/S267K/L368D/K370S (SEQ ID NO: 234)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-D96/C97/A98)_(GGGGS)1_Fc(216)_IgG1_C220S/PVA_/S267K/S364K/E357Q
(SEQ ID NOS 235-237)
ITCPPPMSVEHADIWVKSYSLYSRERYICNSGFKRKAGTSSLTECVLNKATNVAHWTTPSLKCIRDCA/GGGGS/
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 32B

>XENP022361 – empty-Fc-IL15_L52C-human_IL15Ra(Sushi-S40C)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_L52C_no_tag (SEQ ID NO: 238)
NWVNVISDLKKIEDLIQSMHIDATLYTESDVHPSCKVTAMKCFLLELQVISCESGDASIHDTVENLIILANNSLS
SNGNVTESGCKECEEELEEKNIKEFLQSFVHIVQMFINTS

Chain 2 - empty-Fc(216)_IgG1_pI(-)_Isosteric_A_C220S/PVA_/S267K/L368D/K370S (SEQ ID NO: 239)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-S40C)_(GGGGS)1_Fc(216)_IgG1_C220S/PVA_/S267K/S364K/E357Q (SEQ ID NOS 240-242)
ITCPPPMSVEHADIWVKSYSLYSRERYICNSGFKRKAGTCSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022684 empty-Fc-IL15_E87C-human_IL15Ra(Sushi-D96/C97/A98)_Fc(216)_IgG1_pI(-)_Isosteric_A_C220S/PVA_/S267K/L368D/K370S-Fc(216)_IgG1_C220S/PVA_/S267K/S364K/E357Q

Chain 1 – IL15_E87C (SEQ ID NO: 243)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS

Chain 2 - IL15Ra(Sushi-D96/C97/A98)_Fc(216)_IgG1_pI(-)_Isosteric_A_C220S/PVA_/S267K/L368D/K370S
(SEQ ID NOS 244-246)
ITCPPPMSVEHADIWVKSYSLYSRERYICNSGFKRKAGTSSLTECVLNKATNVAHWTTPSLKCIRDCA/EPKSSDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLNGKEYKCKVSNKA
LPAPIEKTISKAKGQPREPQVYTLPPSREQMTKNQVKLTCLVKGFYPSDIAVEWESNGQPENNYKTTPPVLDSDGSFFLYSKLTVDKSRW
QQGNVFSCSVMHEALHNHYTQKSLSLSPGK

Figure 33

>XENP022634 – human_IL15(E87C)-human_IL15Ra(Sushi-D96/C97)_Fc(216)_IgG1_C220S/PVA_/S267K Chain 1 - human_IL15Ra(Sushi-D96/C97)-Fc(216)_IgG1_C220S/PVA_/S267K (SEQ ID NOS 247-249)
ITCPPPMSVEHADIWVKSYSLYSRERYICNSGFKRKAGTSSLTECVLNKATNVAHWTTPSLKCIRDC/EPKSSDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK Chain 2 - human_IL15_E87C_no_tag (SEQ ID NO: 250)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS >XENP022635 – human_IL15(E87C)-human_IL15Ra(Sushi-D96/C97/A98)_Fc(216)_IgG1_C220S/PVA_/S267K Chain 1 - human_IL15Ra(Sushi-D96/C97/A98)-Fc(216)_IgG1_C220S/PVA_/S267K (SEQ ID NOS 251-253)
ITCPPPMSVEHADIWVKSYSLYSRERYICNSGFKRKAGTSSLTECVLNKATNVAHWTTPSLKCIRDCA/EPKSSD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK Chain 2 - human_IL15_E87C_no_tag (SEQ ID NO: 254)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS >XENP022636 – human_IL15(L52C)-human_IL15Ra(Sushi-S40C)_Fc(216)_IgG1_C220S/PVA_/S267K Chain 1 - human_IL15Ra(Sushi-S40C)-Fc(216)_IgG1_C220S/PVA_/S267K (SEQ ID NOS 255-257)
ITCPPPMSVEHADIWVKSYSLYSRERYICNSGFKRKAGTCSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK Chain 2 - human_IL15_L52C_no_tag (SEQ ID NO: 258)
NWVNVISDLKKIEDLIQSMHIDATLYTESDVHPSCKVTAMKCFLLELQVISCESGDASIHDTVENLIILANNSLS
SNGNVTESGCKECEELEEKNIKEFLQSFVHIVQMFINTS >XENP022687 - human_IL15_E87C-human_IL15Ra(Sushi-D96/C97/A98)_Fc(216)_IgG1_C220S/PVA_/S267K Chain 1 – human_IL15Ra(sushi-D96/C97/A98)_Fc(216)_IgG1_C220S/PVA_/S267K (SEQ ID NOS 259-261)
ITCPPPMSVEHADIWVKSYSLYSRERYICNSGFKRKAGTSSLTECVLNKATNVAHWTTPSLKCIRDCA/EPKSSDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLNGKEYKCKVSNKA
LPAPIEKTISKAKGQPREPQVYTLPPSREEMTKNQVSLTCLVKGFYPSDIAVEWESNGQPENNYKTTPPVLDSDGSFFLYSKLTVDKSRW
QQGNVFSCSVMHEALHNHYTQKSLSLSPGK Chain 2 – human_IL15_E87C (SEQ ID NO: 262)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS

Figure 34

>XENP022639 – empty-Fc(216)_IgG1_pI(-
)_Isosteric_A_C220S/PVA_/S267K/L368D/K370S_(GGGGS)2_IL15Ra(Sushi-
D96/C97)_IL15(E87C)_IgG1_ISO(+RR)_C220S/PVA_/S267K/S364K/E357Q

Chain 1 - empty-Fc(216)_IgG1_pI(-)_Isosteric_A_C220S/PVA_/S267K/L368D/K370S_(GGGGS)2_IL15Ra(Sushi-D96/C97) (17605) (SEQ ID NOS 263-265)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIRDC

Chain 2 - empty-Fc(216)_IgG1_ISO(+RR)_C220S/PVA_/S267K/S364K/E357Q (8927) (SEQ ID NO: 266)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Chain 3 - human_IL15_E87C_no_tag (17074) (SEQ ID NO: 267)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS >XENP022640 empty-Fc(216)_IgG1_pI(-
)_Isosteric_A_C220S/PVA_/S267K/L368D/K370S_IgG1_ISO(+RR)_C220S/PVA_/S267K/S364K/E357Q_(GGGGS
)2_IL15Ra(Sushi-D96/C97)_IL15(E87C)

Chain 1 – IL15 (SEQ ID NO: 268)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS

Chain 2 – empty_Fc(216)_IgG1_pI(-)_Isosteric_A_C220S/PVA_/S267K/L368D/K370S (SEQ ID NO: 269)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK

Figure 38A

N1D (SEQ ID NO: 270)
DWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

N4D (SEQ ID NO: 271)
NWVDVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D8N (SEQ ID NO: 272)
NWVNVISNLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D30N (SEQ ID NO: 273)
NWVNVISDLKKIEDLIQSMHIDATLYTESNVHPSCKVTAMKCFLLELQVISLESGDASIHDTVENLIILANNSLSSNGNVTESGCKECEE
LEEKNIKEFLQSFVHIVQMFINTS

D61N (SEQ ID NO: 274)
NWVNVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

E64Q (SEQ ID NO: 275)
NWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

N65D (SEQ ID NO: 276)
NWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

Q108E (SEQ ID NO: 277)
NWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVEMFINTS

N1D/D61N (SEQ ID NO: 278)
DWVNVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

N1D/E64Q (SEQ ID NO: 279)
DWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

N4D/D61N (SEQ ID NO: 280)
NWVDVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

N4D/E64Q (SEQ ID NO: 281)
NWVDVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

D8N/D61N (SEQ ID NO: 282)
NWVNVISNLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

Figure 38B

D8N/E64Q (SEQ ID NO: 283)
NWVNVISNLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

D61N/E64Q (SEQ ID NO: 284)
NWVNVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVQMFINTS

E64Q/Q108E (SEQ ID NO: 285)
NWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVEMFINTS

N1D/N4D/D8N (SEQ ID NO: 286)
DWVDVISNLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D61N/E64Q/N65D (SEQ ID NO: 287)
NWVNVISDLKKIEDLIQSMHIDATLYTESDVHPSCKVTAMKCFLLELQVISLESGDASIHNTVQDLIILANNSLSSNGNVTESGCKECEE
LEEKNIKEFLQSFVHIVQMFINTS

N1D/D61N/E64Q/Q108E (SEQ ID NO: 288)
DWVNVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVEMFINTS

N4D/D61N/E64Q/Q108E (SEQ ID NO: 289)
NWVDVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVEMFINTS

N1D/N65D (SEQ ID NO: 290)
DWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

N1D/Q108E (SEQ ID NO: 291)
DWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVEMFINTS

N4D/N65D (SEQ ID NO: 292)
NWVDVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

D30N/N65D (SEQ ID NO: 293)
NWVNVISDLKKIEDLIQSMHIDATLYTESNVHPSCKVTAMKCFLLELQVISLESGDASIHDTVEDLIILANNSLSSNGNVTESGCKECEE
LEEKNIKEFLQSFVHIVQMFINTS

D30N/Q108E (SEQ ID NO: 294)
NWVNVISDLKKIEDLIQSMHIDATLYTESNVHPSCKVTAMKCFLLELQVISLESGDASIHDTVENLIILANNSLSSNGNVTESGCKECEE
LEEKNIKEFLQSFVHIVEMFINTS

N65D/Q108E (SEQ ID NO: 295)
NWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVEMFINTS

Figure 38C

E64Q/N65D (SEQ ID NO: 296)
NWVNVISDLKKIEDLIQSMHIDATLYTESDVHPSCKVTAMKCFLLELQVISLESGDASIHDTVQDLIILANNSLSSNGNVTESGCKECEE
LEEKNIKEFLQSFVHIVQMFINTS

N1D/N4D/N65D (SEQ ID NO: 297)
DWVDVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

D30N/E64Q/N65D (SEQ ID NO: 298)
NWVNVISDLKKIEDLIQSMHIDATLYTESNVHPSCKVTAMKCFLLELQVISLESGDASIHDTVQDLIILANNSLSSNGNVTESGCKECEE
LEEKNIKEFLQSFVHIVQMFINTS

N4D/D61N/N65D (SEQ ID NO: 299)
NWVDVISDLKKIEDLIQSMHIDATLYTESDVHPSCKVTAMKCFLLELQVISLESGDASIHNTVEDLIILANNSLSSNGNVTESGCKECEE
LEEKNIKEFLQSFVHIVQMFINTS

Figure 39A

>XENP022821 - human_IL15_N65D_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N65D_(GGGGS)₁ (17692) (SEQ ID NOS 300-302)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908)
(SEQ ID NOS 303-305)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022822 - human_IL15_Q108E_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_Q108E_(GGGGS)₁ (17693) (SEQ ID NOS 306-308)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908)
(SEQ ID NOS 309-311)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 39B

>XENP23343 human_IL15_N65D_(GGGGS)1-human_IL15Ra(Sushi)_(GGGGS)1_Fc(216)_IgG1_pI(-)_Isosteric_A_C220S/PVA_/S267K/L368D/K370S/M428L/N434S-Fc(216)_IgG1_C220S/PVA_/S267K/S364K/E357Q/M428L/N434S Chain 1 - human_IL15_N65D_(GGGGS)1_Fc(216)_IgG1_pI(-)_Isosteric_A_C220S/PVA_/S267K/L368D/K370S/M428L/N434S (SEQ ID NOS 312-314)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK Chain 2 - human_IL15Ra(Sushi)_(GGGGS)1_Fc(216)_IgG1_C220S/PVA_/S267K/S364K/E357Q/M428L/N434S (SEQ ID NOS 315-317)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK >XENP023554 - human_IL15_N1D/N65D_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N1D/N65D_(GGGGS)1_Fc(216)_IgG1_pI(-)_Isosteric_A_C220S/PVA_/S267K/L368D/K370S (18783) (SEQ ID NOS 318-320)
DWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (15908) (SEQ ID NOS 321-323)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 39C

>XENP023557 - human_IL15_N4D/N65D_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_N4D/N65D_(GGGGS)1_Fc(216)_IgG1_pI(-)_Isosteric_A_C220S/PVA_/S267K/L368D/K370S (18786) (SEQ ID NOS 324-326)
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Chain 2 - human_IL15Ra(Sushi)_(GGGGS)1_Fc(216)_IgG1_C220S/PVA_/S267K/S364K/E357Q (15908) (SEQ ID NOS 327-329)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

>XENP023561 human_IL15_N65D/Q108E_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_N65D/Q108E_(GGGGS)1_Fc(216)_IgG1_pI(-)_Isosteric_A_C220S/PVA_/S267K/L368D/K370S (SEQ ID NOS 330-332)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Chain 2 - human_IL15Ra(Sushi)_(GGGGS)1_Fc(216)_IgG1_C220S/PVA_/S267K/S364K/E357Q (SEQ ID NOS 333-335)
ITCPPPMSVEHADIWVKSYSLYSRERYICNSGFKRKAGTSSLTECVLNKATNVAHWTTPSLKCIR/GGGGS/EPKSSDKTHTCP
PCPAPPVAGPSVFLFPPKPKDTLMISRTPEVTCVVVDVKHEDPEVKFNWYVDGVEVHNAKTKPREEQYNSTYRVV
SVLTVLHQDWLNGKEYKCKVSNKALPAPIEKTISKAKGQPREPQVYTLPPSREQMTKNQVKLTCLVKGFYPSDIA
VEWESNGQPENNYKTTPPVLDSDGSFFLYSKLTVDKSRWQQGNVFSCSVMHEALHNHYTQKSLSLSPGK

>XENP024018 human_IL15(N65D)-human_IL15Ra(Sushi)_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15(N65D)_Fc(216)_IgG1_pI(-)_Isosteric_A_C220S/PVA_/S267K/L368D/K370S (SEQ ID NOS 336-338)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 2 - human_IL15Ra(Sushi)_Fc(216)_IgG1_C220S/PVA_/S267K/S364K/E357Q (SEQ ID NOS 339-341)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 39D

>XENP024019 - human_IL15(Q108E)-human_IL15Ra(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15(Q108E)-human_IL15Ra(Sushi)_Fc(216)_IgG1_pI(-
)_Isosteric_A_C220S/PVA_/S267K/L368D/K370S (19242) (SEQ ID NOS 342-344)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 - human_IL15Ra(Sushi)_Fc(216)_IgG1_C220S/PVA_/S267K/S364K/E357Q (16481) (SEQ ID NOS 345-347)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP024045 human_IL15_D30N/E64Q/N65D_(GGGGS)1-
human_IL15Rα(Sushi)_(GGGGS)1_Fc(216)_IgG1_pI(-)_Isosteric_A_C220S/PVA_/S267K/L368D/K370S-
Fc(216)_IgG1_C220S/PVA_/S267K/S364K/E357Q Chain 1 – human_IL15_D30N/E64Q/N65D_(GGGGS)1_Fc(216)_IgG1_pI(-
)_Isosteric_A_C220S/PVA_/S267K/L368D/K370S (SEQ ID NOS 348-350)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 – human_IL15Rα(Sushi)_(GGGGS)1_Fc(216)_IgG1_C220S/PVA_/S267K/S364K/E357Q (SEQ ID NOS 351-353)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP024051 human_IL15_N1D/N65D-human_IL15Rα(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_N1D/N65D-human_Fc(216)_IgG1_pI(-
)_Isosteric_A_C220S/PVA_/S267K/L368D/K370S (SEQ ID NOS 354-356)
DWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 – human_IL15Rα(Sushi)_Fc(216)_IgG1_C220S/PVA_/S267K/S364K/E357Q (SEQ ID NOS 357-359)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 39E

>XENP024052 human_IL15_N4D/N65D-human_IL15Rα(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_N4D/N65D-human_Fc(216)_IgG1_pI(-
)_Isosteric_A_C220S/PVA_/S267K/L368D/K370S (SEQ ID NOS 360-362)
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 – human_IL15Rα(Sushi)_Fc(216)_IgG1_C220S/PVA_/S267K/S364K/E357Q (SEQ ID NOS 363-365)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP24306 human_IL15_D30N/E64Q/N65D_(GGGGS)1-
human_IL15Ra(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S Chain 1 - human_IL15_D30N/E64Q/N65D_(GGGGS)1_Fc(216)_IgG1_pI(-
)_Isosteric_A_C220S/PVA_/S267K/L368D/K370S/M428L/N434S (SEQ ID NOS 366-368)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK Chain 2 - human_IL15Ra(Sushi)_(GGGGS)1_Fc(216)_IgG1_C220S/PVA_/S267K/S364K/E357Q/M428L/N434S
(SEQ ID NOS 369-371)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK

Figure 40A

>XENP24013 human_IL15Ra(sushi)_(GGGGS)5-human_IL15(D61N;single-Chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(D61N;single-Chain)_Fc(216)_IgG1_pI(-)_Isosteric_A_C220S/PVA_/S267K/L368D/K370S (SEQ ID NOS 372-375)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHNTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - empty-Fc(216)_IgG1_C220S/PVA_/S267K/S364K/E357Q (SEQ ID NO: 376)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP24014 human_IL15Ra(sushi)_(GGGGS)5-human_IL15(N65D;single-Chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(N65D;single-Chain)_Fc(216)_IgG1_pI(-)_Isosteric_A_C220S/PVA_/S267K/L368D/K370S (SEQ ID NOS 377-380)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - empty_Fc(216)_IgG1_C220S/PVA_/S267K/S364K/E357Q (SEQ ID NO: 381)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP024015 human_IL15Ra(sushi)_(GGGGS)5-human_IL15(Q108E;single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(Q108E;single-chain)_Fc(216)_IgG1_pI(-)_Isosteric_A_C220S/PVA_/S267K/L368D/K370S (SEQ ID NOS 382-385)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVEMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 – empty_Fc(216)_IgG1_C220S/PVA_/S267K/S364K/E357Q (SEQ ID NO: 386)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 40B

>XENP024050 human_IL15Ra(sushi)_(GGGGS)5-human_IL15_N4D/N65D_(single-chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)5-human_IL15_N4D/N65D_(single-chain)_Fc(216)_IgG1_pI(-
)_Isosteric_A_C220S/PVA_/S267K/L368D/K370S (SEQ ID NOS 387-390)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 391)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP24294 human_IL15Ra(sushi)_(GGGGS)5-human_IL15_N4D/N65D_(single-Chain
)-empty-Fc_Fc(216)_IgG1_pI(-)_Isosteric_A_C220S/PVA_/S267K/L368D/K370S/M428L/N434S-
Fc(216)_IgG1_C220S/PVA_/S267K/S364K/E357Q/M428L/N434S Chain 1 - human_IL15Ra(sushi)_(GGGGS)5-human_IL15_N4D/N65D_(single-Chain
)_Fc(216)_IgG1_pI(-)_Isosteric_A_C220S/PVA_/S267K/L368D/K370S/M428L/N434S (SEQ ID NOS 392-395)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK Chain 2 - empty_Fc(216)_IgG1_C220S/PVA_/S267K/S364K/E357Q/M428L/N434S (SEQ ID NO: 396)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVLHEALHSHYTQKSL
SLSPGK

Figure 40C

>XENP024475 human_IL15Ra(sushi)_(GGGGS)6-human_IL15(single-chain;Q108E)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)6-human_IL15(single-chain;Q108E)_Fc(216)_IgG1_pI(-)_Isosteric_A_C220S/PVA_/S267K/L368D/K370S (SEQ ID NOS 397-400)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGSGGGGS</u>/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVEMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK

Chain 2 – empty_Fc(216)_IgG1_C220S/PVA_/S267K/S364K/E357Q (SEQ ID NO: 401)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP024476 human_IL15Ra(sushi)_(GGGGS)6-human_IL15(single-chain;N4D/N65D)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)6-human_IL15(single-chain;N4D/N65D)_Fc(216)_IgG1_pI(-)_Isosteric_A_C220S/PVA_/S267K/L368D/K370S (SEQ ID NOS 402-405)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGSGGGGS</u>/NWVDVISDLKKIEDLIQSMHIDATLYTESDVHPSCKVTAMKCFLLELQVISLE
SGDASIHDTVEDLIILANNSLSSNGNVTESGCKECEELEEKNIKEFLQSFVHIVQMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK

Chain 2 – empty_Fc(216)_IgG1_C220S/PVA_/S267K/S364K/E357Q (SEQ ID NO: 406)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP024478 human_IL15Ra(sushi)_(GGGGS)7-human_IL15(single-chain;Q108E)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)7-human_IL15(single-chain;Q108E)_Fc(216)_IgG1_pI(-)_Isosteric_A_C220S/PVA_/S267K/L368D/K370S (SEQ ID NOS 407-410)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGSGGGGSGGGGS</u>/NWVNVISDLKKIEDLIQSMHIDATLYTESDVHPSCKVTAMKCFLLELQ
VISLESGDASIHDTVENLIILANNSLSSNGNVTESGCKECEELEEKNIKEFLQSFVHIVEMFINTS/EPKSSDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK

Chain 2 – empty_Fc(216)_IgG1_C220S/PVA_/S267K/S364K/E357Q (SEQ ID NO: 411)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 40D

>XENP024479 human_IL15Ra(sushi)_(GGGGS)7-human_IL15(single-chain;N4D/N65D)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)7-human_IL15(single-chain;N4D/N65D)_Fc(216)_IgG1_pI(-)_Isosteric_A_C220S/PVA_/S267K/L368D/K370S (SEQ ID NOS 412-415)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGSGGGGSGGGGS</u>/NWVDVISDLKKIEDLIQSMHIDATLYTESDVHPSCKVTAMKCFLLELQ
VISLESGDASIHDTVEDLIILANNSLSSNGNVTESGCKECEELEEKNIKEFLQSFVHIVQMFINTS/EPKSSDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK

Chain 2 - empty-Fc_Fc(216)_IgG1_C220S/PVA_/S267K/S364K/E357Q (SEQ ID NO: 416)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP024481 human_IL15Ra(sushi)_(30AA_linker_variant)-human_IL15(single-chain;Q108E)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(30AA_linker_variant)-human_IL15(single-chain;Q108E)_Fc(216)_IgG1_pI(-)_Isosteric_A_C220S/PVA_/S267K/L368D/K370S (SEQ ID NOS 417-420)
ITCPPPMSVEHADIWVKSYSLYSRERYICNSGFKRKAGTSSLTECVLNKATNVAHWTTPSLKCIR/<u>DPALVHQRP
APPGGGGSGGGGSGGGGSGGG</u>/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVEMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK

Chain 2 – empty_ Fc(216)_IgG1_C220S/PVA_/S267K/S364K/E357Q (SEQ ID NO: 421)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 41A

>XENP024349 IL15_Q108E_(non-covalent)-human_IL15Rα(Sushi)_empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 – human_IL15Rα(Sushi)_ Isosteric_A_C220S/PVA_/S267K/L368D/K370S (SEQ ID NOS 422-424)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 2 – empty- Fc(216)_IgG1_C220S/PVA_/S267K/S364K/E357Q (SEQ ID NO: 425)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Chain 3 – IL15_Q108E_(non-covalent) (SEQ ID NO: 426)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS >XENP024890 IL15_N4D/N65D_(non-covalent)-human_IL15Ra(Sushi)-empty-Fc_IgG1_Fc(216)_IgG1_pI(-)_Isosteric_A_C220S/PVA_/S267K/L368D/K370S-IgG1_PVA_/S267K/S364K/E357Q

Chain 1 – IL-15_N4D/N65D (SEQ ID NOS 427-429)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 2 - human_IL15Ra(Sushi)_Fc(216)_IgG1_pI(-)_Isosteric_A_C220S/PVA_/S267K/L368D/K370S (SEQ ID NOS 430-432)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 3 – empty_Fc(216)_ IgG1_PVA_/S267K/S364K/E357Q (SEQ ID NO: 433)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 41B

>XENP25138 IL15_D30N/E64Q/N65D_(non-covalent)-empty-Fc_Fc(216)_IgG1_pI(-
)_Isosteric_A_C220S/PVA_/S267K/L368D/K370S-IgG1_PVA_/S267K/S364K/E357Q

Chain 1 - IL15_D30N/E64Q/N65D (SEQ ID NO: 434)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS

Chain 2 - human_IL15Ra(Sushi)_Fc(216)_IgG1_pI(-)_Isosteric_A_C220S/PVA_/S267K/L368D/K370S (SEQ ID NOS 435-437)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 3 - empty_Fc(216)_IgG1_PVA_/S267K/S364K/E357Q (SEQ ID NO: 438)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 42

>XENP022801 - human_IL15_N65D(non-covalent)-human_IL15Rα(Sushi)

Chain 1 - human_IL15_N65D(non-covalent) (17672) (SEQ ID NO: 439)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS

Chain 2 - human_IL15Rα(Sushi) (17033) (SEQ ID NO: 440)
ITCPPPMSVEHADIWVKSYSLYSRERYICNSGFKRKAGTSSLTECVLNKATNVAHWTTPSLKCIR

>XENP022802 - human_IL15_Q108E(non-covalent)-human_IL15Rα(Sushi)

Chain 1 - human_IL15_Q108E(non-covalent) (17673) (SEQ ID NO: 441)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS

Chain 2 - human_IL15Rα(Sushi) (17033) (SEQ ID NO: 442)
ITCPPPMSVEHADIWVKSYSLYSRERYICNSGFKRKAGTSSLTECVLNKATNVAHWTTPSLKCIR

Figure 43

>XENP024342 human_IL15(non-covalent; Q108E)-human_IL15Rα(Sushi)_Fc(216)_IgG1_C220S/PVA_/S267K

Chain 1 – human_IL15Rα(Sushi)_Fc(216)_IgG1_C220S/PVA_/S267K (SEQ ID NOS 443-445)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Chain 2 –human_IL15(non-covalent; Q108E) (SEQ ID NO: 446)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS

Figure 44

>XENP023472 empty-Fc-IL15_N65D/E87C-human_IL15Ra(Sushi-D96/C97)_Fc(216)_IgG1_pI(-
)_Isosteric_A_C220S/PVA_/S267K/L368D/K370S-Fc(216)_IgG1_C220S/PVA_/S267K/S364K/E357Q

Chain 1 – empty_ Fc(216)_IgG1_pI(-)_Isosteric_A_C220S/PVA_/S267K/L368D/K370S (SEQ ID NO: 447)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 2 - IL15_N65D/E87C (SEQ ID NO: 448)
NWVNVISDLKKIEDLIQSMHIDATLYTESDVHPSCKVTAMKCFLLELQVISLESGDASIHDTVEDLIILANNSLS
SNGNVTESGCKCCEELEEKNIKEFLQSFVHIVQMFINTS

Chain 3 - IL15Ra(Sushi-D96/C97)_Fc(216)_IgG1_C220S/PVA_/S267K/S364K/E357Q (SEQ ID NOS 449-451)
ITCPPPMSVEHADIWVKSYSLYSRERYICNSGFKRKAGTSSLTECVLNKATNVAHWTTPSLKCIRDC/EPKSSDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK >XENP023473 empty-Fc-IL15_N65D/L52C-human_IL15Ra(Sushi-S40C)_Fc(216)_IgG1_pI(-
)_Isosteric_A_C220S/PVA_/S267K/L368D/K370S-Fc(216)_IgG1_C220S/PVA_/S267K/S364K/E357Q

Chain 1 – empty_ Fc(216)_IgG1_pI(-)_Isosteric_A_C220S/PVA_/S267K/L368D/K370S (SEQ ID NO: 452)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 2 - IL15_N65D/L52C (SEQ ID NO: 453)
NWVNVISDLKKIEDLIQSMHIDATLYTESDVHPSCKVTAMKCFLLELQVISCESGDASIHDTVEDLIILANNSLS
SNGNVTESGCKECEELEEKNIKEFLQSFVHIVQMFINTS

Chain 3 - IL15Ra(Sushi-S40C)_Fc(216)_IgG1_C220S/PVA_/S267K/S364K/E357Q (SEQ ID NOS 454-456)
ITCPPPMSVEHADIWVKSYSLYSRERYICNSGFKRKAGTCSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 46

| XENP | Variant | EC50 pM (NK cells) | Fold reduced (NK cells) | EC50 pM (CD8 T cells) | Fold reduced (CD8 T cells) |
|---|---|---|---|---|---|
| 20818 | WT | 200.6 | | 637.1 | |
| 21478 | single-chain | 848.5 | 4.2 | 4982.0 | 7.8 |
| 22815 | N1D | 281.3 | 1.4 | 1051.0 | 1.6 |
| 22816 | N4D | 321.9 | 1.6 | 1190.0 | 1.9 |
| 22817 | D8N | very weak | very weak | very weak | very weak |
| 22818 | D30N | 376.3 | 1.9 | 1366.0 | 2.1 |
| 22819 | D61N | 5934.0 | 29.6 | 161937.0 | >100 |
| 22820 | E64Q | 877.0 | 4.4 | 2858.0 | 4.5 |
| 22821 | N65D | 2883.0 | 14.4 | 6928.0 | 10.9 |
| 22822 | Q108E | 9777.0 | 48.7 | very weak | >100 |
| 22823 | N1D/D61N | 918.0 | 4.6 | 4225.0 | 6.6 |
| 22824 | N1D/E64Q | 1091.0 | 5.4 | 4228.0 | 6.6 |
| 22825 | N4D/D61N | 309.0 | 1.5 | 1070.0 | 1.7 |
| 22826 | N4D/E64Q | very weak | very weak | very weak | very weak |
| 22827 | D8N/D61N | ND | ND | ND | ND |
| 22828 | D8N/E64Q | 597.7 | 3.0 | 1658.0 | 2.6 |
| 22829 | D61N/E64Q | 458.2 | 2.3 | 2115.0 | 3.3 |
| 22830 | E64Q/Q108E | 436.6 | 2.2 | 1815.0 | 2.8 |
| 22831 | N1D/N4D/D8N | very weak | very weak | very weak | very weak |
| 22832 | D61N/E64Q/N65D | ND | ND | ND | ND |
| 22833 | N1D/D61N/E64Q/Q108E | ND | ND | ND | ND |
| 22834 | N4D/D61N/E64Q/Q108E | very weak | very weak | very weak | very weak |

| XENP | EC50 nM (NK cells) | Fold reduced (NK cells) | EC50 nM (CD8 T cells) | Fold reduced (CD8 T cells) | EC50 nM (CD4 T cells) | Fold reduced (CD4 T cells) |
|---|---|---|---|---|---|---|
| 20818 | 0.3223 | 1.0 | 2.701 | 1.0 | 16.467 | 1.0 |
| 21478 | 1.116 | 3.5 | 11.728 | 4.3 | 28.349 | 1.7 |
| 22818 | 0.4205 | 1.3 | 2.829 | 1.0 | 40.676 | 2.5 |
| 22819 | 1.016 | 3.2 | 8.254 | 3.1 | 18.101 | 1.1 |
| 22820 | 0.562 | 1.7 | 3.918 | 1.5 | 10.362 | 0.6 |
| 22821 | 3.14 | 9.7 | 18.706 | 6.9 | 112.823 | 6.9 |
| 22822 | 68.866 | 213.7 | 6439.69 | 2384.2 | 48.738 | 3.0 |
| 22825 | 1.769 | 5.5 | 12.09 | 4.5 | 60.081 | 3.6 |
| 22826 | 1.448 | 4.5 | 9.678 | 3.6 | 22.41 | 1.4 |
| 22829 | 4.839 | 15.0 | 29.638 | 11.0 | 337.571 | 20.5 |
| 22834 | 331.293 | 1027.9 | 4107.897 | 1520.9 | ND | ND |
| IL-15 | 0.05322 | 0.2 | 0.3452 | 0.1 | ND | ND |

Figures 48A-48B
Figure 48A
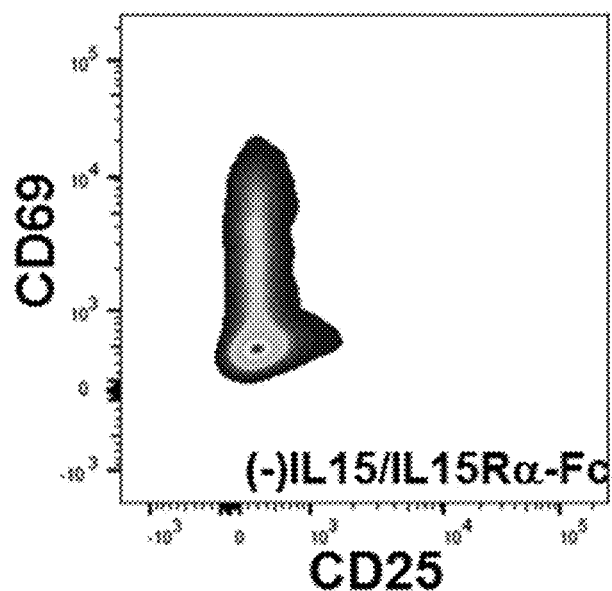
Figure 48B
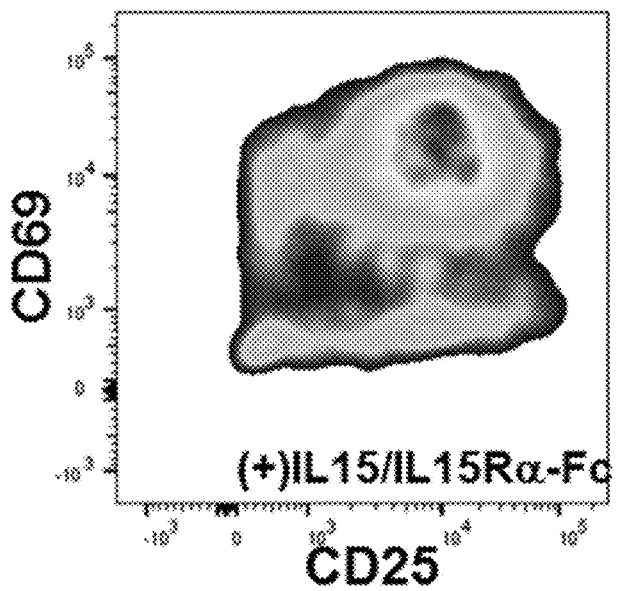

Figures 57A-57D
Figure 57A
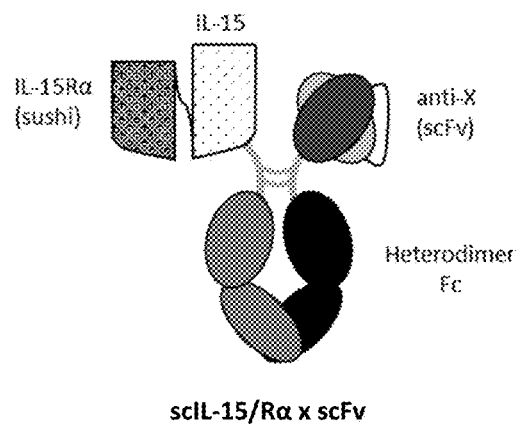
scIL-15/Rα x scFv
Figure 57B
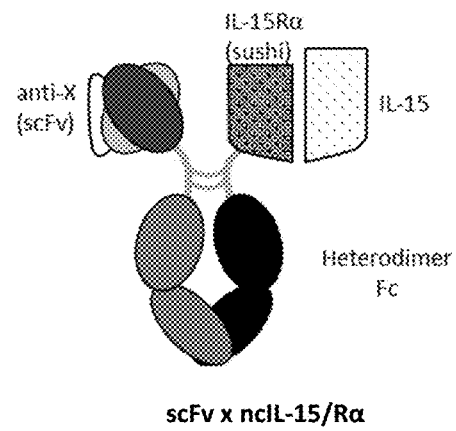
scFv x ncIL-15/Rα
Figure 57C
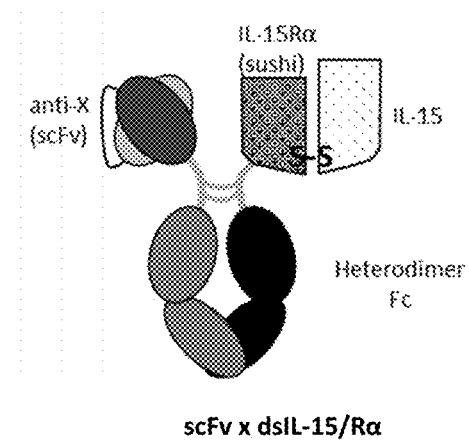
scFv x dsIL-15/Rα
Figure 57D
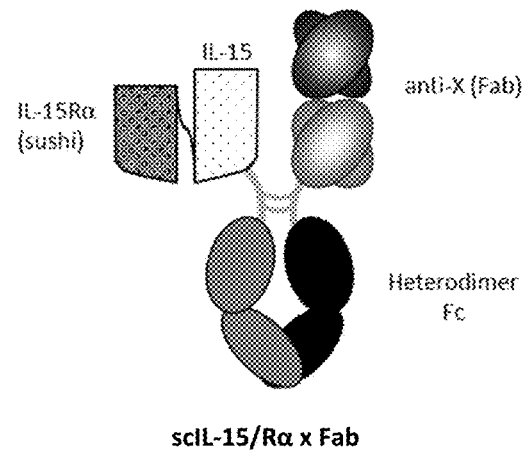
scIL-15/Rα x Fab
Example: XENP24114

Figures 57E-57H
Figure 57E
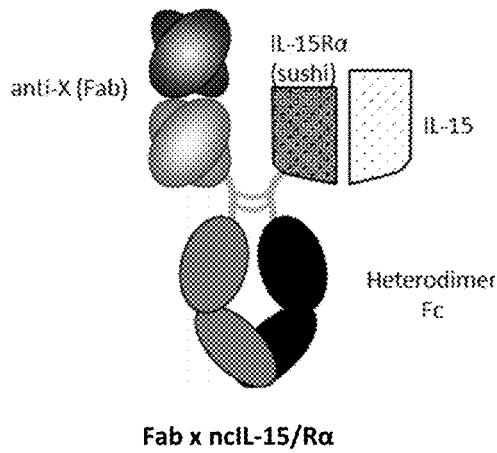
Fab x ncIL-15/Rα
Example: XENP25137
Figure 57F
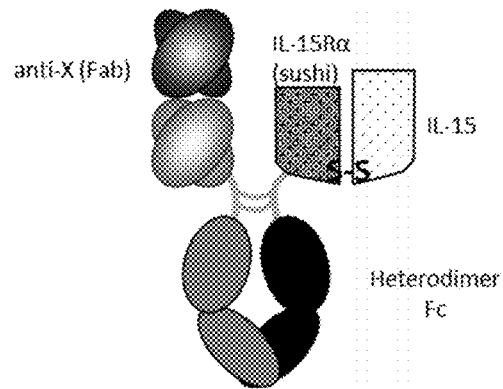
Fab x dsIL-15/Rα
Figure 57G
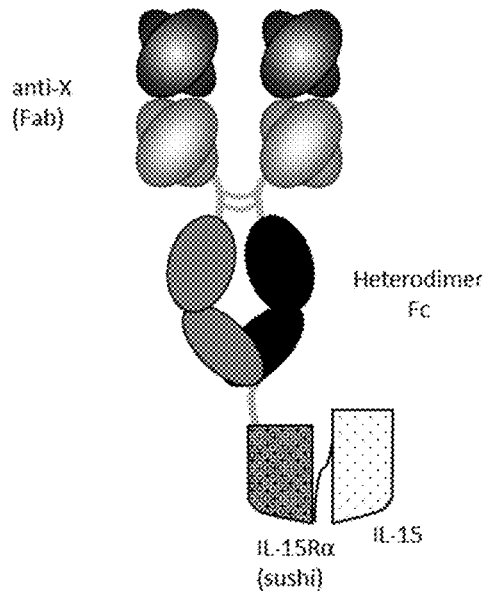
mAb-scIL-15/Rα
Example: XENP24546
Figure 57H
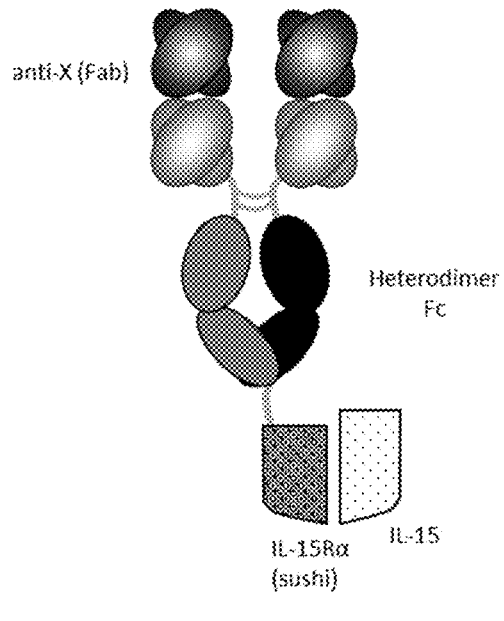
mAb-ncIL-15/Rα
Example: XENP24543

Figures 57I-57K
Figure 57I
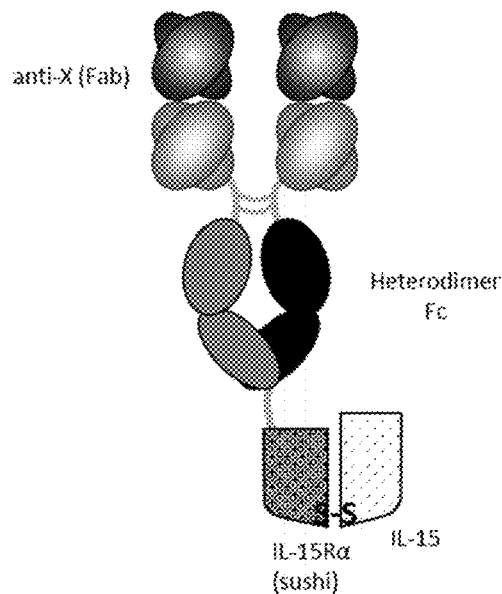
mAb-dsIL-15/Rα
Figure 57J
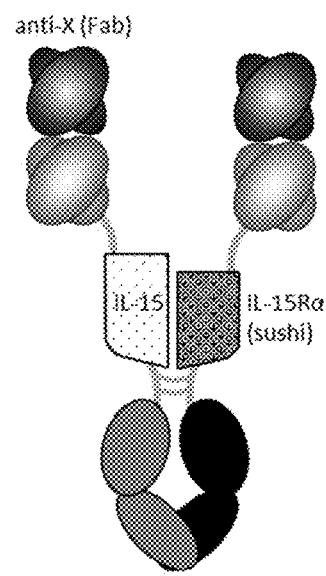
central-IL-15/Rα
Example: XENP24547
Figure 57K
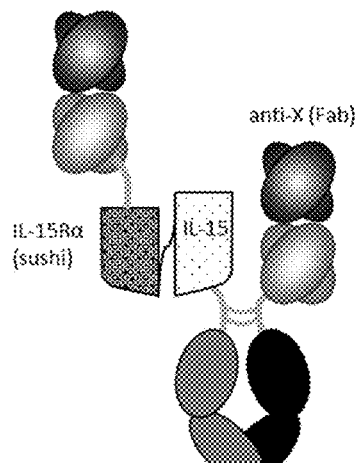
central-scIL-15/Rα
Example: XENP24548

Figure 58

>XENP024541 monalizumab[NKG2A]_H1L1

Chain 1 - monalizumab[NKG2A]_H1L1 Heavy Chain (SEQ ID NOS 457-461)
QVQLVQSGAEVKKPGASVKVSCKASGYTFTSYWMNWVRQAPGQGLEWMGRIDPYDSETHYAQKLQGRVTMTTDTS
TSTAYMELRSLRSDDTAVYYCARGGYDFDVGTLYWFFDVWGQGTTVTVSS/ASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKVDKKVE
PKSCDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREEMTKNQVSLTC
LVKGFYPSDIAVEWESNGQPENNYKTTPPVLDSDGSFFLYSKLTVDKSRWQQGNVFSCSVMHEALHNHYTQKSLS
LSPGK Chain 2 - monalizumab[NKG2A]_H1L1 Light Chain (SEQ ID NOS 462-466)
DIQMTQSPSSLSASVGDRVTITCRASENIYSYLAWYQQKPGKAPKLLIYNAKTLAEGVPSRFSGSGSGTDFTLTI
SSLQPEDFATYYCQHHYGTPRTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP024542 monalizumab[NKG2A]_H0L0
Chain 1 - monalizumab[NKG2A]_H0L0 Heavy Chain (SEQ ID NOS 467-471)
QVQLQQPGAELVRPGASVKLSCKASGYTFTSYWMNWVKQRPEQGLQWIGRIDPYDSETHYSQKFKDKAILTVDKS
SSTAYMRLSSLTSEDSAVYYCARGGYDFDVGTLYWFFDVWGAGTTVTVSS/ASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKVDKKVE
PKSCDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREEMTKNQVSLTC
LVKGFYPSDIAVEWESNGQPENNYKTTPPVLDSDGSFFLYSKLTVDKSRWQQGNVFSCSVMHEALHNHYTQKSLS
LSPGK Chain 2 - monalizumab[NKG2A]_H0L0 Light Chain (SEQ ID NOS 472-476)
DIQMTQSPASLSASVGETVTITCRASENIYSYLAWYQQKQGKSPQFLVYNAKTLAEGVPSRFSGSGSGTQFSLKI
NSLQPEDFGSYYCQHHYGTPRTFGGGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 59

>XENP024365 MS[NKG2D]_H0L0
Chain 1 - MS[NKG2D]_H0L0 Heavy Chain (SEQ ID NOS 477-481)
QVHLQESGPGLVKPSETLSLTCTVSDDSISSYYWSWIRQPPGKGLEWIGHISYSGSANYNPSLKSRVTISVDTSK
NQFSLKLSSVTAADTAVYYCANWDDAFNIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRV
VSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK Chain 2 - MS[NKG2D]_H0L0 Light Chain (SEQ ID NOS 482-486)
EIVLTQSPGTLSLSPGERATLSCRASQSVSSSYLAWYQQKPGQAPRLLIYGASSRATGIPDRFSGSGSGTDFTLT
ISRLEPEDFAVYYCQQYGSSPWTFGQGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 60A

>XENP024531 human IL15Rα(sushi)-human IL15(N65D;single-Chain) x monalizumab[NKG2A] H1L1 IgG1

Chain 1 - human_IL15Rα(sushi)_(GGGGS)5-human_IL15(N65D; single-chain)-Fc (SEQ ID NOS 487-490)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGS</u>/NWVNVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - monalizumab[NKG2A]_H1L1 Fab-Fc Heavy Chain (SEQ ID NOS 491-495)
QVQLVQSGAEVKKPGASVKVSCKASGYTFTSYWMNWVRQAPGQGLEWMGRIDPYDSETHYAQKLQGRVTMTTDTS
TSTAYMELRSLRSDDTAVYYCARGGYDFDVGTLYWFFDVWGQGTTVTSS/ASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKVDKKVE
PKSCDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTC
LVKGFYPSDIAVEWESNGQPENNYKTTPPVLDSDGSFFLYSKLTVDKSRWQQGNVFSCSVMHEALHNHYTQKSLS
LSPGK

Chain 3 - monalizumab[NKG2A]_H1L1 Light Chain(SEQ ID NOS 496-500)
DIQMTQSPSSLSASVGDRVTITCRASENIYSYLAWYQQKPGKAPKLLIYNAKTLAEGVPSRFSGSGSGTDFTLTI
SSLQPEDFATYYCQHHYGTPRTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP024532 human IL15Rα(sushi)-human IL15(Q108E; single-chain) x monalizumab[NKG2A] H1L1

Chain 1 - human_IL15Rα(sushi)_(GGGGS)5-human_IL15(Q108E; single-chain)-Fc (SEQ ID NOS 501-504)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGS</u>/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVEMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - monalizumab[NKG2A]_H1L1 Fab-Fc Heavy Chain (SEQ ID NOS 505-509)
QVQLVQSGAEVKKPGASVKVSCKASGYTFTSYWMNWVRQAPGQGLEWMGRIDPYDSETHYAQKLQGRVTMTTDTS
TSTAYMELRSLRSDDTAVYYCARGGYDFDVGTLYWFFDVWGQGTTVTSS/ASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKVDKKVE
PKSCDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTC
LVKGFYPSDIAVEWESNGQPENNYKTTPPVLDSDGSFFLYSKLTVDKSRWQQGNVFSCSVMHEALHNHYTQKSLS
LSPGK

Chain 3 - monalizumab[NKG2A]_H1L1 Light Chain (SEQ ID NOS 510-514)
DIQMTQSPSSLSASVGDRVTITCRASENIYSYLAWYQQKPGKAPKLLIYNAKTLAEGVPSRFSGSGSGTDFTLTI
SSLQPEDFATYYCQHHYGTPRTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 60B

>XENP027146 human IL15Ra(sushi) (GGGGS)5-human IL15(N4D/N65D;single-chain)-
monalizumab [NKG2A] H1L1 IgG1 Fc(216) IgG1 pI(-
) Isosteric A C220S/PVA /S267K/L368D/K370S-IgG1 PVA /S267K/S364K/E357Q Chain 1 - human_IL15Ra(sushi)_(GGGGS)5-human_IL15(N4D/N65D;single-chain)-Fc
(SEQ ID NOS 515-518)
ITCPPPMSVEHADIWVKSYSLYSRERYICNSGFKRRAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - monalizumab_[NKG2A]_H1L1 Fab-Fc Heavy Chain (SEQ ID NOS 519-523)
QVQLVQSGAEVKKPGASVKVSCKASGYTFTSYWMNWVRQAPGQGLEWMGRIDPYDSETHYAQKLQGRVTMTTDTS
TSTAYMELRSLRSDDTAVYYCARGGYDFDVGTLYWFFDVWGQGTTVTVSS/ASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKVDKKVE
PKSCDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTC
LVKGFYPSDIAVEWESNGQPENNYKTTPPVLDSDGSFFLYSKLTVDKSRWQQGNVFSCSVMHEALHNHYTQKSLS
LSPGK Chain 3 - monalizumab[NKG2A]_H1L1 Light Chain (SEQ ID NOS 524-528)
DIQMTQSPSSLSASVGDRVTITCRASENIYSYLAWYQQKPGKAPKLLIYNAKTLAEGVPSRFSGSGSGTDFTLTI
SSLQPEDFATYYCQHHYGTPRTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 61A

>XENP024533 human IL15Rα(sushi)-human IL15(N65D; single-chain) x
MS[NKG2D] H0L0

Chain 1 - human_IL15Rα(sushi)_(GGGGS)5-human_IL15(N65D; single-chain)-Fc
(SEQ ID NOS 529-532)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - MS[NKG2D]_H0L0 Fab-Fc Heavy Chain (SEQ ID NOS 533-537)
QVHLQESGPGLVKPSETLSLTCTVSDDSISSYYWSWIRQPPGKGLEWIGHISYSGSANYNPSLKSRVTISVDTSK
NQFSLKLSSVTAADTAVYYCANWDDAFNIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQKSLSLSPGK

Chain 3 - MS[NKG2D]_H0L0 Light Chain (SEQ ID NOS 538-542)
EIVLTQSPGTLSLSPGERATLSCRASQSVSSSYLAWYQQKPGQAPRLLIYGASSRATGIPDRFSGSGSGTDFTLT
ISRLEPEDFAVYYCQQYGSSPWTFGQGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP024534 human IL15Rα(sushi)-human IL15(Q108E; single-chain) x
MS[NKG2D] H0L0

Chain 1 - human_IL15Rα(sushi)_(GGGGS)5-human_IL15(Q108E; single-chain)-Fc
(SEQ ID NOS 543-546)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVEMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - MS[NKG2D]_H0L0 Fab-Fc Heavy Chain (SEQ ID NOS 547-551)
QVHLQESGPGLVKPSETLSLTCTVSDDSISSYYWSWIRQPPGKGLEWIGHISYSGSANYNPSLKSRVTISVDTSK
NQFSLKLSSVTAADTAVYYCANWDDAFNIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQKSLSLSPGK

Chain 3 - MS[NKG2D]_H0L0 Light Chain (SEQ ID NOS 552-556)
EIVLTQSPGTLSLSPGERATLSCRASQSVSSSYLAWYQQKPGQAPRLLIYGASSRATGIPDRFSGSGSGTDFTLT
ISRLEPEDFAVYYCQQYGSSPWTFGQGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 61B

>XENP027145 human_IL15Ra(sushi)_(GGGGS)5-human_IL15(N4D/N65D;single-chain)-
MS[NKG2D]_H0L0 IgG1 Fc(216) IgG1 pI(-
) Isosteric A C220S/PVA /S267K/L368D/K370S-IgG1 PVA /S267K/S364K/E357Q

**Chain 1 - human_IL15Ra(sushi)_(GGGGS)5-human_IL15(N4D/N65D;single-chain)-
Fc**(SEQ ID NOS 557-560)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - MS[NKG2D]_H0L0 Fab-Fc Heavy Chain (SEQ ID NOS 561-565)
QVHLQESGPGLVKPSETLSLTCTVSDDSISSYYWSWIRQPPGKGLEWIGHISYSGSANYNPSLKSRVTISVDTSK
NQFSLKLSSVTAADTAVYYCANWDDAFNIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQKSLSLSPGK

Chain 3 - MS[NKG2D]_H0L0 Light Chain (SEQ ID NOS 566-570)
EIVLTQSPGTLSLSPGERATLSCRASQSVSSSYLAWYQQKPGQAPRLLIYGASSRATGIPDRFSGSGSGTDFTLT
ISRLEPEDFAVYYCQQYGSSPWTFGQGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 65A

>XENP015076 51.1 H0L0 Heavy Chain
Chain 1 - 51.1_H0L0 Heavy Chain (SEQ ID NOS 571-575)
QIQLVQSGPELRKPGETVRISCKASGYSFTNFGMIWVKQAPGKGLKWLGWINTYTGEPTYADDLKGRFAFSLETS
ANTAYLKINNFKNEDMATYFCARKDYAGFFDYWGQGTTLTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHYTQKSLSLSPGK Chain 2 - 51.1_H0L0 Light Chain (SEQ ID NOS 576-580)
DILMTQSPSSMSVSLGDTVSITCHASQDIGSNMGWLQQKPGKSFKALIYHGTNLEYGVPSRFSGSGSGADYSLSI
SSLESEDFADYYCVQFAQFPYTFGGGTSLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP015251 51.1 H1L1 Heavy Chain
Chain 1 - 51.1_H1L1 Heavy Chain (SEQ ID NOS 581-585)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHYTQKSLSLSPGK Chain 2 - 51.1_H1L1 Light Chain (SEQ ID NOS 586-590)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP023647 51.1 H1L1 Fab
Chain 1 - 51.1_H1L1_Fab Heavy Chain (SEQ ID NOS 591-595)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCGS Chain 2 - 51.1_H1L1_Fab Light Chain (SEQ ID NOS 596-600)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 65B

>XENP024317 one-armed 51.1 H1 L1.60

Chain 1 - 51.1[CD8]_H1_L1.60 Heavy Chain (SEQ ID NOS 601-605)

QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSDTKVDKKVEPKSCDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK

Chain 2 - 51.1[CD8]_H1_L1.60 Light Chain (SEQ ID NOS 606-610)
DILMTQSPSSLSASVGDRVTITCQASQDIGSDMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC Chain 3 - empty-Fc (SEQ ID NO: 611)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 66A

><ins>XENP024114 human IL15Rα(sushi)-human IL15(single-chain) x 51.1[CD8] H1L1</ins>
Chain 1 - human_IL15Rα(sushi)_GGGGS)5-human_IL15(single-chain)-Fc (SEQ ID
NOS 612-615)
ITCPPPMSVEHADIWVKSYSLYSRERYICNSGFKRKAGTSSLTECVLNKATNVAHWTTPSLKCIR/<ins>GGGGSGGGG</ins>
<ins>SGGGGSGGGGSGGGGS</ins>/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 51.1[CD8]_H1L1 Fab-Fc Heavy Chain (SEQ ID NOS 616-620)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK Chain 3 - 51.1[CD8]_H1L1 Fab-Fc Light Chain (SEQ ID NOS 621-625)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC ><ins>XENP024115 human IL15Rα(sushi)-human IL15(D61N; single-chain) x</ins>
<ins>51.1[CD8] H1L1</ins>

Chain 1 - human_IL15Rα(sushi)_(GGGGS)5-human_IL15(D61N; single-chain)-Fc
(SEQ ID NOS 626-629)
ITCPPPMSVEHADIWVKSYSLYSRERYICNSGFKRKAGTSSLTECVLNKATNVAHWTTPSLKCIR/<ins>GGGGSGGGG</ins>
<ins>SGGGGSGGGGSGGGGS</ins>/NWVNVISDLKKIEDLIQSMHIDATLYTESDVHPSCKVTAMKCFLLELQVISLESGDAS
IHNTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 51.1[CD8]_H1L1 Fab-Fc Heavy Chain (SEQ ID NOS 630-634)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK Chain 3 - 51.1[CD8]_H1L1 Fab-Fc Light Chain (SEQ ID NOS 635-639)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 66B

>XENP024116 human IL15Rα(sushi)-human IL15(N65D; single-chain) x
51.1[CD8] H1L1

Chain 1 - human_IL15Rα(sushi)_(GGGGS)5-human_IL15(N65D; single-chain)-Fc
(SEQ ID NOS 640-643)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 51.1[CD8]_H1L1 Fab-Fc Heavy Chain (SEQ ID NOS 644-648)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK Chain 3 - 51.1[CD8]_H1L1 Fab-Fc Light Chain (SEQ ID NOS 649-653)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

- XENP22822 IL15(Q108E)/Rα-Fc heterodimer
- XENP24014 scIL15(N65D)/Rα-Fc
- 24116B scIL15(N65D)/Rα x anti-CD8
- rh IL-15

- XENP22822 IL15(Q108E)/Rα-Fc heterodimer
- XENP24014 scIL15(N65D)/Rα-Fc
- XENP24116 scIL15(N65D)/Rα x anti-CD8
- rh IL-15

- XENP22822 IL15(Q108E)/Ra-Fc heterodimer
- XENP24014 scIL15(N65D)/Rα-Fc
- XENP24116 scIL15(N65D)/Rα x anti-CD8
- rh IL-15

- XENP22822 IL15(Q108E)/Rα-Fc heterodimer
- XENP24014 scIL15(N65D)/Rα-Fc
- XENP24116 scIL15(N65D)/Rα x anti-CD8
- rh IL-15

- XENP22822 IL15(Q108E)/Rα-Fc heterodimer
- XENP24014 scIL15(N65D)/Rα-Fc
- XENP24116 scIL-15(N65D)/Rα x anti-CD8
- rh IL-15

- XENP22822 IL15(Q108E)/Rα-Fc heterodimer
- XENP24014 scIL15(N65D)/Rα-Fc
- XENP24116 scIL15(N65D)/Rα x anti-CD8
- rh IL-15

Figure 79A

>XENP024543 51.1[CD8] H1L1 bivalent x IL15Rα(sushi)-IL15 (N65D; non-covalent)

Chain 1 - 51.1[CD8]_H1L1_Fab-Fc-Heavy Chain-IL15Rα(sushi) (SEQ ID NOS 654-659)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSDTKVDKKVEPKSCDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK/G
GGGSGGGGS/ITCPPPMSVEHADIWVKSYSLYSRERYICNSGFKRKAGTSSLTECVLNKATNVAHWTTPSLKCIR Chain 2 - 51.1[CD8]_H1L1 Fab-Fc Heavy Chain (SEQ ID NOS 660-664)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK Chain 3 - 51.1[CD8]_H1L1 Fab-Fc Light Chain (SEQ ID NOS 665-669)
DIQMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC Chain 4 - IL15(N65D) (SEQ ID NO: 670)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS

>XENP024546 51.1[CD8]_H1L1_IgG1 bivalent x IL15Rα(sushi)-IL15 (single-chain)

Chain 1 - 51.1[CD8]_H1-Fc-IL15Rα(sushi)_(GGGGS)5-IL15(single-chain) (SEQ ID NOS 671-677)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSDTKVDKKVEPKSCDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSP/GGG
GGSGGGGS/ITCPPPMSVEHADIWVKSYSLYSRERYICNSGFKRKAGTSSLTECVLNKATNVAHWTTPSLKCIR/
GGGGSGGGGSGGGGSGGGGSGGGGS/NWVNVISDLKKIEDLIQSMHIDATLYTESDVHPSCKVTAMKCFLLELQV
ISLESGDASIHDTVENLIILANNSLSSNGNVTESGCKECEELEEKNIKEFLQSFVHIVQMFINTS Chain 2 - 51.1[CD8]_H1L1 Fab-Fc Heavy Chain (SEQ ID NOS 678-682)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK Chain 3 - 51.1[CD8]_H1L1 Light Chain (SEQ ID NOS 683-687)
DIQMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 79B

>XENP024547 51.1[CD8]_H1L1 bivalent x IL15 N4D/N65D-IL15Rα(sushi)

Chain 1 - 51.1[CD8]_H1-IL15(N4D/N65D)-Fc (SEQ ID NOS 688-694)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSC/<u>GG
GGSGGGGS</u>/NWVDVISDLKKIEDLIQSMHIDATLYTESDVHPSCKVTAMKCFLLELQVISLESGDASIHDTVEDL
IILANNSLSSNGNVTESGCKECEELEEKNIKEFLQSFVHIVQMFINTS/<u>GGGGS</u>/EPKSSDKTHTCPPCPAPPVA
GPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWEQGDVFSCSVMHEALHNHYTQKSLSLSPGK Chain 2 - 51.1[CD8]_H1-IL15Rα(sushi)-Fc (SEQ ID NOS 695-701)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSC/<u>GG
GGSGGGGS</u>/ITCPPPMSVEHADIWVKSYSLYSRERYICNSGFKRKAGTSSLTECVLNKATNVAHWTTPSLKCIR/
<u>GGGGS</u>/EPKSSDKTHTCPPCPAPPVAGPSVFLFPPKPKDTLMISRTPEVTCVVVDVKHEDPEVKFNWYVDGVEVH
NAKTKPREEQYNSTYRVVSVLTVLHQDWLNGKEYKCKVSNKALPAPIEKTISKAKGQPREPQVYTLPPSREMTK
NQVKLTCLVKGFYPSDIAVEWESNGQPENNYKTTPPVLDSDGSFFLYSKLTVDKSRWQQGNVFSCSVMHEALHNH
YTQKSLSLSPGK Chain 3 - 51.1[CD8]_H1L1 Light Chain (SEQ ID NOS 702-706)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP024548 51.1[CD8]_H1L1-IL15Rα(sushi)-IL15 x 51.1_H1L1_Fab

Chain 1 - 51.1[CD8]_H1-IL15Rα(sushi)_(GGGGS)5-IL15-Fc (SEQ ID NOS 707-714)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSC/<u>GG
GGSGGGGS</u>/ITCPPPMSVEHADIWVKSYSLYSRERYICNSGFKRKAGTSSLTECVLNKATNVAHWTTPSLKCIR/
<u>GGGGSGGGGSGGGGSGGGGSGGGGS</u>/NWVNVISDLKKIEDLIQSMHIDATLYTESDVHPSCKVTAMKCFLLELQV
ISLESGDASIHDTVENLIILANNSLSSNGNVTESGCKECEELEEKNIKEFLQSFVHIVQMFINTS/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK Chain 2 - 51.1[CD8]_H1L1 Fab-Fc Heavy Chain (SEQ ID NOS 715-719)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREMTKNQVKLTCLVKGFYP
SDIAVEWESNGQPENNYKTTPPVLDSDGSFFLYSKLTVDKSRWQQGNVFSCSVMHEALHNHYTQKSLSLSPGK Chain 3 - 51.1[CD8]_H1L1 Light Chain (SEQ ID NOS 720-724)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figures 80A-80B
Figure 80A
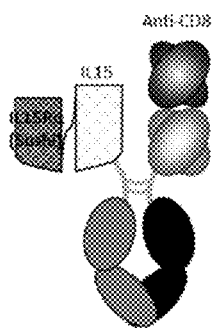
Figure 80B
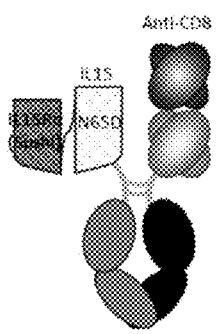

Figures 80C-80D
Figure 80C
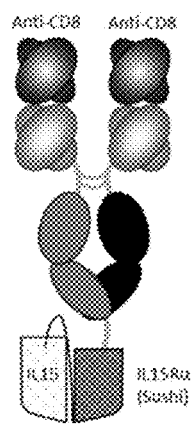
Figure 80D
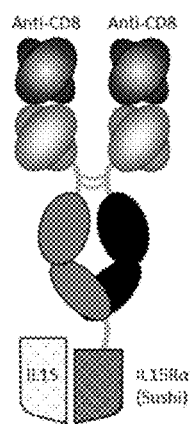

Figures 80E-80F
Figure 80E
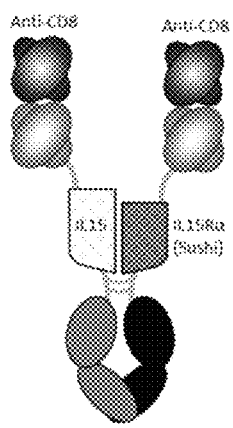
Figure 80F
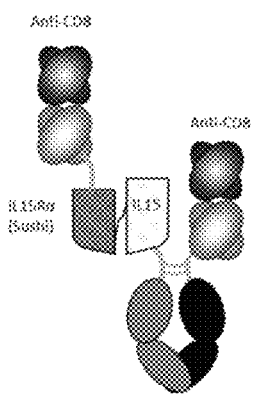

Figure 81

>XENP024025 1C11B3[CD8]
Chain 1 – 1C11B3[CD8]_H1L1 Heavy Chain (SEQ ID NOS 725-729)
EVQLLESGGGLVQPGGSLRLSCAASGFTFGSYAMSWVRQAPGKGLEWVSTITASGGTTFYADSVKGRFTISRDNS
KNTLYLQMNSLRAEDTAVYYCAKDADGYGAIAFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREEMTKNQVSLTCLVKG
FYPSDIAVEWESNGQPENNYKTTPPVLDSDGSFFLYSKLTVDKSRWQQGNVFSCSVMHEALHNHYTQKSLSLSPG
K

Chain 2 – 1C11B3[CD8]_H1L1 Light Chain (SEQ ID NOS 730-734)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP024321 one-armed 1C11B3[CD8]_H1L1
Chain 1 – 1C11B3[CD8]_H1L1 Fab-Fc Heavy Chain (SEQ ID NOS 735-739)
EVQLLESGGGLVQPGGSLRLSCAASGFTFGSYAMSWVRQAPGKGLEWVSTITASGGTTFYADSVKGRFTISRDNS
KNTLYLQMNSLRAEDTAVYYCAKDADGYGAIAFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 – 1C11B3[CD8]_H1L1 Fab-Fc Light Chain (SEQ ID NOS 740-744)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Chain 3 – empty-Fc (SEQ ID NO: 745)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 87

>XENP24736 human_IL15Ra(sushi)_(GGGGS)5-human_IL15(N4D/N65D;single-Chain
)-1C11B3[CD8]_H1L1_IgG1_Fc(216)_IgG1_pI(-)_Isosteric_A_C220S/PVA_/S267K/L368D/K370S-
IgG1_PVA_/S267K/S364K/E357Q Chain 1 - human_IL15Ra(sushi)_(GGGGS)5-human_IL15(N4D/N65D;single-Chain
)_Fc(216)_IgG1_pI(-)_Isosteric_A_C220S/PVA_/S267K/L368D/K370S (SEQ ID NOS 746-749)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 1C11B3[CD8]_H1_IgG1_PVA_/S267K/S364K/E357Q Heavy Chain (SEQ ID NOS 750-754)
EVQLLESGGGLVQPGGSLRLSCAASGFTFGSYAMSWVRQAPGKGLEWVSTITASGGTTFYADSVKGRFTISRDNS
KNTLYLQMNSLRAEDTAVYYCAKDADGYGAIAFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVMHEALHNHYTQKSLSLSPG
K Chain 3 - 1C11B3[CD8]_L1 Light Chain (SEQ ID NOS 755-759)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 89

>OKT8_H0.1 (Murine Variable Heavy) (SEQ ID NOS 760-763)
QVKLQESGAELVKPGASVKLSCTASGFNIKDTYIHFVRQRPEQGLEWIGRIDPANDNTLYASKFQGKATITADTS
SNTAYMHLSSLTSGDTAVYYCGRGYGYYVFDHWGQGTTVTVSS

>OKT8_H1 (Humanized Variable Heavy V1) (SEQ ID NOS 764-767)
EVQLQQSGAEVKKPGASVKVSCKASGFNIKDTYIHWVRQAPGKGLEWMGRIDPANDNTLYASKFQGRVTITADTS
TNTAYMELSSLRSEDTAVYYCGRGYGYYVFDHWGQGTTVTVSS

>OKT8_H2 (Humanized Variable Heavy V2) (SEQ ID NOS 768-771)
QVQLVQSGAEVKKPGASVKVSCKASGFNIKDTYIHWVRQAPGKGLEWMGRIDPANDNTLYASKFQGRVTITADTS
INTAYMELSRLRSDDTAVYYCGRGYGYYVFDHWGQGTTVTVSS

>OKT8_L0.1 (Murine Variable Light) (SEQ ID NOS 772-775)
DIKMTQSPSFLAASPGETITINCRTSRSISQYLAWYQEKPGKTNKLLIYSGSTLQSGIPSRFSGSGSGTDFTLTI
SGLEPEDFAMYYCQQHNENPLTFGAGTKLEIK

>OKT8_L1 (Humanized Variable Light V1) (SEQ ID NOS 776-779)
DIKMTQSPSSLSASVGDRVTITCRTSRSISQYLAWYQEKPGKTNKLLIYSGSTLQSGIPSRFSGSGSGTDFTLTI
SSLQPEDFATYYCQQHNENPLTFGAGTKLEIK

Figure 90

>XENP15075 OKT8_H1L1_IgG1_PVA_/S267K

XENP15075 Heavy Chain (SEQ ID NOS 780-784)
EVQLQQSGAEVKKPGASVKVSCKASGFNIKDTYIHWVRQAPGKGLEWMGRIDPANDNTLYASKFQGRVTITADTS
TNTAYMELSSLRSEDTAVYYCGRGYGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHYTQKSLSLSPGK

XENP15075 Light Chain (SEQ ID NOS 785-789)
DIKMTQSPSSLSASVGDRVTITCRTSRSISQYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 91

>XENP24920 empty-Fc-OKT8[CD8]_H2L1_IgG1_Fc(216)_IgG1_pI(-
)_Isosteric_A_C220S/PVA_/S267K/L368D/K370S-IgG1_PVA_/S267K/S364K/E357Q

Chain 1 - empty_Fc(216)_IgG1_pI(-)_Isosteric_A_C220S/PVA_/S267K/L368D/K370S (SEQ ID NO: 790)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 2 - OKT8[CD8]_H2_IgG1_PVA_/S267K/S364K/E357Q Heavy Chain (SEQ ID NOS 791-795)
QVQLVQSGAEVKKPGASVKVSCKASGFNIKDTYIHWVRQAPGKGLEWMGRIDPANDNTLYASKFQGRVTITADTS
INTAYMELSRLRSDDTAVYYCGRGYGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1 Light Chain (SEQ ID NOS 796-800)
DIKMTQSPSSLSASVGDRVTITCRTSRSISQYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 92A

>XENP24917_human_IL15Ra(sushi)_(GGGGS)5-human_IL15(N4D/N65D;single-Chain)-
OKT8[CD8]_H1L1_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S scIL-15/Ra-Fc Chain** (SEQ ID NOS 801-804)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H1_IgG1_PVA_/S267K/S364K/E357Q Heavy Chain (SEQ ID NOS 805-809)
EVQLQQSGAEVKKPGASVKVSCKASGFNIKDTYIHWVRQAPGKGLEWMGRIDPANDNTLYASKFQGRVTITADTS
TNTAYMELSSLRSEDTAVYYCGRGYGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1 Light Chain (SEQ ID NOS 810-814)
DIKMTQSPSSLSASVGDRVTITCRTSRSISQYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 92B

>XENP24918 human_IL15Ra(sushi)_(GGGGS)5-human_IL15(N4D/N65D;single-Chain)-OKT8[CD8]_H2L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-Chain)_Fc(216)_IgG1_pI(-)_Isosteric_A_C220S/PVA_/S267K/L368D/K370S scIL-15/Ra-Fc Chain (SEQ ID NOS 815-818)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H2_IgG1_PVA_/S267K/S364K/E357Q Heavy Chain (SEQ ID NOS 819-823)
QVQLVQSGAEVKKPGASVKVSCKASGFNIKDTYIHWVRQAPGKGLEWMGRIDPANDNTLYASKFQGRVTITADTS
INTAYMELSRLRSDDTAVYYCGRGYGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1 Light Chain (SEQ ID NOS 824-828)
DIKMTQSPSSLSASVGDRVTITCRTSRSISQYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP24919 human_IL15Ra(sushi)_(GGGGS)5-human_IL15(N4D/N65D;single-Chain)-OKT8[CD8]_H0.1_L0_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-Chain)_Fc(216)_IgG1_pI(-)_Isosteric_A_C220S/PVA_/S267K/L368D/K370S scIL-15/Ra-Fc Chain (SEQ ID NOS 829-832)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H0.1_IgG1_PVA_/S267K/S364K/E357Q Heavy Chain (SEQ ID NOS 833-837)
QVKLQESGAELVKPGASVKLSCTASGFNIKDTYIHFVRQRPEQGLEWIGRIDPANDNTLYASKFQGKATITADTS
SNTAYMHLSSLTSGDTAVYYCGRGYGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_H0.1_L0_IgG1_PVA_/S267K/S364K/E357Q Light Chain (SEQ ID NOS 838-842)
DIKMTQSPSFLAASPGETITINCRTSRSISQYLAWYQEKPGKTNKLLIYSGSTLQSGIPSRFSGSGSGTDFTLTI
SGLEPEDFAMYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 92C

>XENP25137 IL15_D30N/E64Q/N65D_(non-covalent)-human_IL15Ra(Sushi)-
OKT8[CD8]_H2L1_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(Sushi)_Fc(216)_IgG1_pI(-)_Isosteric_A_C220S/PVA_/S267K/L368D/K370S IL-15Rα(sushi)-Fc Chain (SEQ ID NOS 843-845)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 2 – IL15_D30N/E64Q/N65D (SEQ ID NO: 846)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS

Chain 3 - OKT8[CD8]_H2_IgG1_PVA_/S267K/S364K/E357Q Heavy Chain (SEQ ID NOS 847-851)
QVQLVQSGAEVKKPGASVKVSCKASGFNIKDTYIHWVRQAPGKGLEWMGRIDPANDNTLYASKFQGRVTITADTS
INTAYMELSRLRSDDTAVYYCGRGYGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 4 - OKT8[CD8]_L1 Light Chain (SEQ ID NOS 852-856)
DIKMTQSPSSLSASVGDRVTITCRTSRSISQYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

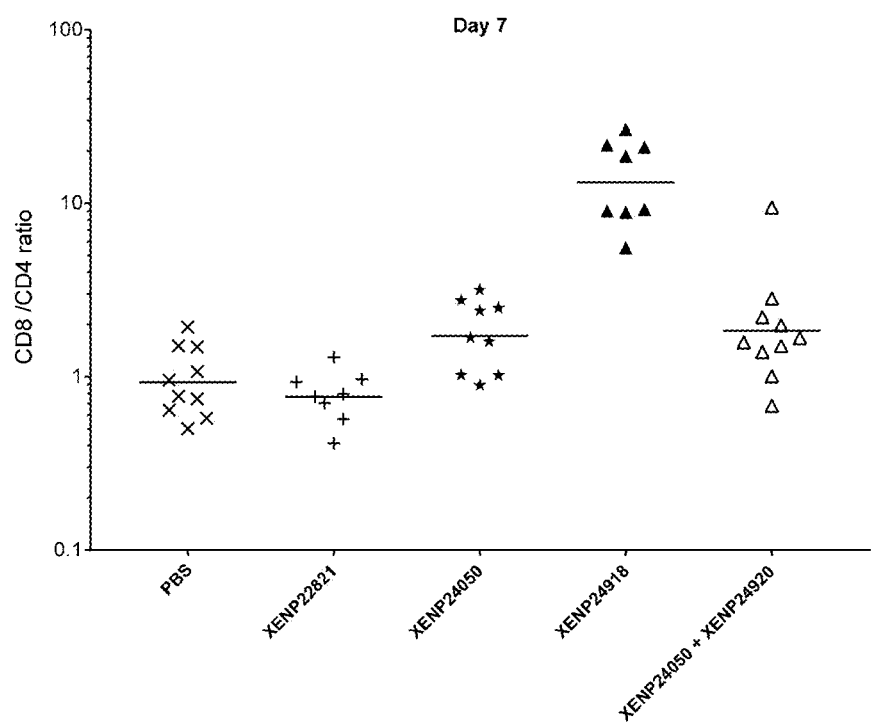

Figure 95A

>OKT8_H2.152 Variable Heavy (SEQ ID NOS 857-860)
QVQLVQSGAEVKKPGASVKVSCKASGFNIKDTYIHWVRQAPGKGLEWMGRIDPDNGETLYASKFQGRVTITADTS
INTAYMELSRLRSDDTAVYYCGRGYGYYVFDHWGQGTTVTVSS >OKT8_H2.153 Variable Heavy (SEQ ID NOS 861-864)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGYGYYVFDHWGQGTTVTVSS >OKT8_H2.154 Variable Heavy (SEQ ID NOS 865-868)
QVQLVQSGAEVKKPGASVKVSCKASGFNIKDTYIHWVRQAPGKGLEWMGRIDPDNGETLYASKFQGRVTITADTS
INTAYMELSRLRSDDTAVYYCGRGYGKYVFDHWGQGTTVTVSS >OKT8_H2.155 Variable Heavy (SEQ ID NOS 869-872)
QVQLVQSGAEVKKPGASVKVSCKASGFNIKDTYIHWVRQAPGKGLEWMGRIDPDNGETLYASKFQGRVTITADTS
INTAYMELSRLRSDDTAVYYCGRGYGYYYFDHWGQGTTVTVSS >OKT8_H2.156 Variable Heavy (SEQ ID NOS 873-876)
QVQLVQSGAEVKKPGASVKVSCKASGFNIKDTYIHWVRQAPGKGLEWMGRIDPDNGETLYASKFQGRVTITADTS
INTAYMELSRLRSDDTAVYYCGRGWGYYVFDHWGQGTTVTVSS >OKT8_H2.157 Variable Heavy (SEQ ID NOS 877-880)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGYGKYVFDHWGQGTTVTVSS >OKT8_H2.158 Variable Heavy (SEQ ID NOS 881-884)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGYGYYYFDHWGQGTTVTVSS >OKT8_H2.159 Variable Heavy (SEQ ID NOS 885-888)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGWGYYVFDHWGQGTTVTVSS >OKT8_H2.160 Variable Heavy (SEQ ID NOS 889-892)
QVQLVQSGAEVKKPGASVKVSCKASGFNIKDTYIHWVRQAPGKGLEWMGRIDPDNDETLYASKFQGRVTMTADTS
INTAYMELSRLRSDDTAVYYCGRGYGYYVFDHWGQGTTVTVSS >OKT8_H2.161 Variable Heavy (SEQ ID NOS 893-896)
QVQLVQSGAEVKKPGASVKVSCKASGFNIKDTYIHWVRQAPGKGLEWMGRIDPDNDETLYASKFQGRVTITADTS
INTAYMELSRLRSDDTAVYYCGRGYGKYVFDHWGQGTTVTVSS >OKT8_H2.162 Variable Heavy (SEQ ID NOS 897-900)
QVQLVQSGAEVKKPGASVKVSCKASGFNIKDTYIHWVRQAPGKGLEWMGRIDPDNDETLYASKFQGRVTITADTS
INTAYMELSRLRSDDTAVYYCGRGYGYYYFDHWGQGTTVTVSS >OKT8_H2.163 Variable Heavy (SEQ ID NOS 901-904)
QVQLVQSGAEVKKPGASVKVSCKASGFNIKDTYIHWVRQAPGKGLEWMGRIDPDNDETLYASKFQGRVTITADTS
INTAYMELSRLRSDDTAVYYCGRGWGYYVFDHWGQGTTVTVSS >OKT8_H2.164 Variable Heavy (SEQ ID NOS 905-908)
QVQLVQSGAEVKKPGASVKVSCKASGFNIKDTYIHWVRQAPGKGLEWMGRIDPDNDETLYASKFQGRVTMTADTS
INTAYMELSRLRSDDTAVYYCGRGYGKYVFDHWGQGTTVTVSS

Figure 95B

>OKT8_H2.165 Variable Heavy (SEQ ID NOS 909-912)
QVQLVQSGAEVKKPGASVKVSCKASGFNIKDTYIHWVRQAPGKGLEWMGRIDPDNDETLYASKFQGRVTMTADTS
INTAYMELSRLRSDDTAVYYCGRGYGYYYFDHWGQGTTVTVSS

>OKT8_H2.166 Variable Heavy (SEQ ID NOS 913-916)
QVQLVQSGAEVKKPGASVKVSCKASGFNIKDTYIHWVRQAPGKGLEWMGRIDPDNDETLYASKFQGRVTMTADTS
INTAYMELSRLRSDDTAVYYCGRGWGYYVFDHWGQGTTVTVSS

>OKT8_L1.103 Variable Light (SEQ ID NOS 917-920)
AIKMTQSPSSLSASVGDRVTITCRTSRSISKYLAWYQEKPGKTNKLLIYSGSTLQSGIPSRFSGSGSGTDFTLTI
SSLQPEDFATYYCQQHNENPLTFGAGTKLEIK

>OKT8_L1.113 Variable Light (SEQ ID NOS 921-924)
AIKMTQSPSSLSASVGDRVTITCRTSRSISIYLAWYQEKPGKTNKLLIYKGSTLQSGIPSRFSGSGSGTDFTLTI
SSLQPEDFATYYCQQANENPLTFGAGTKLEIK

Figure 96

| XENP | Variant | Human CD8 | | | Cyno CD8 | | | $K_D$ hu/cyno |
|---|---|---|---|---|---|---|---|---|
| | | $K_D$ (M) | $k_a$ (1/Ms) | $k_d$ (1/s) | $K_D$ (M) | $k_a$ (1/Ms) | $k_d$ (1/s) | |
| 24920 | H2L1 | 1.20E-08 | 5.00E+05 | 6.00E-03 | 2.02E-07 | 3.47E+05 | 6.99E-02 | 0.06 |
| 26009 | H2.152_L1.103 | 2.44E-09 | 5.06E+05 | 1.23E-03 | 7.76E-08 | 1.17E+05 | 9.09E-03 | 0.03 |
| 26019 | H2.152_L1.113 | 1.60E-09 | 5.58E+05 | 8.92E-04 | 8.07E-08 | 1.19E+05 | 9.62E-03 | 0.02 |
| 26230 | H2.153_L1.103 | 1.74E-09 | 4.82E+05 | 8.39E-04 | 3.92E-08 | 2.47E+05 | 9.67E-03 | 0.04 |
| 26231 | H2.154_L1.103 | 9.55E-08 | 2.36E+05 | 2.26E-02 | 9.59E-08 | 9.25E+04 | 8.87E-03 | 1.00 |
| 26232 | H2.155_L1.103 | 2.25E-09 | 5.73E+05 | 1.29E-03 | 3.57E-08 | 3.19E+05 | 1.14E-02 | 0.06 |
| 26233 | H2.156_L1.103 | 3.49E-09 | 6.34E+05 | 2.21E-03 | 6.66E-08 | 2.00E+05 | 1.33E-02 | 0.05 |
| 26234 | H2.157_L1.103 | 4.82E-08 | 2.58E+05 | 1.24E-02 | 5.56E-08 | 8.06E+04 | 4.48E-03 | 0.87 |
| 26235 | H2.158_L1.103 | 1.38E-09 | 7.18E+05 | 9.92E-04 | 3.35E-08 | 1.43E+05 | 4.77E-03 | 0.04 |
| 26236 | H2.159_L1.103 | 2.49E-09 | 6.80E+05 | 1.69E-03 | 5.51E-08 | 1.22E+05 | 6.72E-03 | 0.05 |
| 26237 | H2.160_L1.103 | 2.27E-09 | 5.07E+05 | 1.15E-03 | 6.74E-08 | 1.14E+05 | 7.67E-03 | 0.03 |
| 26238 | H2.161_L1.103 | 9.66E-08 | 2.71E+05 | 2.62E-02 | 1.07E-07 | 8.39E+04 | 8.94E-03 | 0.91 |
| 26239 | H2.162_L1.103 | 2.57E-09 | 6.82E+05 | 1.75E-03 | 6.66E-08 | 1.33E+05 | 8.82E-03 | 0.04 |
| 26240 | H2.163_L1.103 | 4.43E-09 | 5.98E+05 | 2.65E-03 | 7.54E-08 | 2.98E+05 | 2.25E-02 | 0.06 |
| 26241 | H2.164_L1.103 | 5.56E-08 | 2.65E+05 | 1.48E-02 | 6.70E-08 | 8.80E+04 | 5.89E-03 | 0.83 |
| 26242 | H2.165_L1.103 | 1.88E-09 | 5.91E+05 | 1.11E-03 | 3.00E-08 | 3.22E+05 | 9.68E-03 | 0.06 |
| 26243 | H2.166_L1.103 | 3.14E-09 | 6.26E+05 | 1.96E-03 | 5.59E-08 | 1.92E+05 | 1.08E-02 | 0.06 |

Figure 97A

>XENP26223 human_IL15Ra(sushi)_(GGGGS)5-human_IL15(N4D/N65D;single-Chain)-
OKT8[CD8]_H2.157_L1.103_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S scIL-15/Ra-Fc Chain** (SEQ ID NOS 925-928)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H2.157_IgG1_PVA_/S267K/S364K/E357Q Heavy Chain (SEQ ID NOS 929-933)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGYGKYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1.103 Light Chain (SEQ ID NOS 934-938)
AIKMTQSPSSLSASVGDRVTITCRTSRSISKYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC >XENP26224 human_IL15Ra(sushi)_(GGGGS)5-human_IL15(N4D/N65D;single-Chain)-
OKT8[CD8]_H2.158_L1.103_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S scIL-15/Ra-Fc Chain** (SEQ ID NOS 939-942)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H2.158_IgG1_PVA_/S267K/S364K/E357Q Heavy Chain (SEQ ID NOS 943-947)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGYGYYYFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1.103 Light Chain (SEQ ID NOS 948-952)
AIKMTQSPSSLSASVGDRVTITCRTSRSISKYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 97B

**>XENP26227 human_IL15Ra(sushi)_(GGGGS)5-human_IL15(N4D/N65D;single-Chain)-
OKT8[CD8]_H2.164_L1.103_IgG1_Fc(216)_IgG1_pI(-)_Isosteric_A_C220S/PVA_/S267K/L368D/K370S-
IgG1_PVA_/S267K/S364K/E357Q**

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S scIL-15/Ra-Fc Chain** (SEQ ID NOS 953-956)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H2.164_IgG1_PVA_/S267K/S364K/E357Q Heavy Chain (SEQ ID NOS 957-961)
QVQLVQSGAEVKKPGASVKVSCKASGFNIKDTYIHWVRQAPGKGLEWMGRIDPDNDETLYASKFQGRVTMTADTS
INTAYMELSRLRSDDTAVYYCGRGYGKYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1.103 Light Chain (SEQ ID NOS 962-966)
AIKMTQSPSSLSASVGDRVTITCRTSRSISKYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

**>XENP26229 human_IL15Ra(sushi)_(GGGGS)5-human_IL15(N4D/N65D;single-Chain)-
OKT8[CD8]_H2.166_L1.103_IgG1_Fc(216)_IgG1_pI(-)_Isosteric_A_C220S/PVA_/S267K/L368D/K370S-
IgG1_PVA_/S267K/S364K/E357Q**

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S scIL-15/Ra-Fc Chain** (SEQ ID NOS 967-970)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H2.166_IgG1_PVA_/S267K/S364K/E357Q Heavy Chain (SEQ ID NOS 971-975)
QVQLVQSGAEVKKPGASVKVSCKASGFNIKDTYIHWVRQAPGKGLEWMGRIDPDNDETLYASKFQGRVTMTADTS
INTAYMELSRLRSDDTAVYYCGRGWGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1.103 Light Chain (SEQ ID NOS 976-980)
AIKMTQSPSSLSASVGDRVTITCRTSRSISKYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 102

>XENP26585 human_IL15Ra(sushi)_(GGGGS)5-human_IL15(N4D/N65D;single-Chain)-
OKT8[CD8]_H2.157_L1.103_IgG1_Fc(216)_IgG1_pI(-
)_Isosteric_A_C220S/PVA_/S267K/L368D/K370S/M428L/N434S-
IgG1_PVA_/S267K/S364K/E357Q/M428L/N434S

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S/M428L/N434S scIL-15/Ra-Fc Chain** (SEQ ID NOS 981-984)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - OKT8[CD8]_H2.157_IgG1_PVA_/S267K/S364K/E357Q/M428L/N434S Heavy Chain (SEQ ID NOS 985-989)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGYGKYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK

Chain 3 - OKT8[CD8]_L1.103 Light Chain (SEQ ID NOS 990-994)
AIKMTQSPSSLSASVGDRVTITCRTSRSISKYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC — (A) PBS + PBS
— (B) huPBMC + PBS
— (C) XENP16432 (3.0 mg/kg)
— (D) XENP26585 (1.0 mg/kg)
— (E) XENP26585 (1.0 mg/kg) + XENP16432 (3.0 mg/kg)

— (A) PBS + PBS
— (B) huPBMC + PBS
— (C) XENP16432 (3.0 mg/kg)
— (D) XENP26585 (1.0 mg/kg)
— (E) XENP26585 (1.0 mg/kg) + XENP16432 (3.0 mg/kg)

→ (A) PBS + PBS
→ (B) huPBMC + PBS
→ (C) XENP16432 (3.0 mg/kg)
→ (D) XENP26585 (1.0 mg/kg)
→ (E) XENP26585 (1.0 mg/kg) + XENP16432 (3.0 mg/kg)

→ (B) huPBMC + PBS
→ (C) XENP16432 (3.0 mg/kg)
→ (D) XENP26585 (1.0 mg/kg)
→ (E) XENP26585 (1.0 mg/kg) + XENP16432 (3.0 mg/kg)

TARGETED HETERODIMERIC FC FUSION PROTEINS CONTAINING IL-15 IL-15ALPHA AND ANTIGEN BINDING DOMAINS

CROSS-REFERENCE TO RELATED APPLICATIONS

This application claims priority under 35 U.S.C. § 119(e) to U.S. Provisional Application No. 62/527,898, filed Jun. 30, 2017, which is expressly incorporated herein by reference in its entirety, with particular reference to the figures, legends, and claims therein.

SEQUENCE LISTING

The instant application contains a Sequence Listing which has been submitted electronically in ASCII format and is hereby incorporated by reference in its entirety. Said ASCII copy, created on Sep. 13, 2018, is named 067461-5209-WO_SL.txt and is 1,336,476 bytes in size.

BACKGROUND OF THE INVENTION

IL-2 and IL-15 function in aiding the proliferation and differentiation of B cells, T cells, and NK cells. Both cytokines exert their cell signaling function through binding to a trimeric complex consisting of two shared receptors, the common gamma chain (γc; CD132) and IL-2 receptor β-chain (IL-2Rβ; CD122), as well as an alpha chain receptor unique to each cytokine: IL-2 receptor alpha (IL-2Rα; CD25) or IL-15 receptor alpha (IL-15Rα; CD215). Both cytokines are considered as potentially valuable therapeutics in oncology and IL-2 has been approved for use in patients with metastatic renal-cell carcinoma and malignant melanoma. Currently, there are no approved uses of recombinant IL-15, although several clinical trials are ongoing.

IL-2 preferentially proliferates T cells that display the high affinity receptor complex (i.e. IL-2Rα/β/γ complex). Because regulatory T cells (Tregs; CD4+CD25$^{high}$Foxp3+) constitutively express IL-2Rα (CD25), T cell proliferation by IL-2 is skewed in favor of Tregs which suppresses the immune response and is therefore unfavorable for oncology treatment. This imbalance has led to the concept of high dose IL-2; however, this approach creates additional problems because of IL-2 mediated toxicities such as vascular leak syndrome.

In contrast, IL-15 is primarily presented as a membrane-bound heterodimeric complex with IL-15Rα on monocytes and dendritic cells, and its effects are realized through trans-presentation of the IL-15/IL-15Rα complex to the intermediate affinity receptor complex (i.e., IL-2Rβ/γ complex), which are found for example on NK cells and CD8+ T cells. However, while the IL-15/IL-15Rα complex does not skew in favor of Tregs, the complex still contributes to Treg proliferation which as discussed above is unfavorable for oncology treatment. Therefore, there remains an unmet need in oncology treatment for therapeutic strategies which skew in favor of CD8+ T cell proliferation and activation. Furthermore, a high CD8/CD4 T cell ratio in TILs is generally considered a good prognostic marker for tumor therapy. Stimulation and proliferation of CD4 effector T cells is also thought to contribute to greater amounts of cytokine release compared to CD8 effectors, and lessening this effect could make IL-15 treatment safer with less side effects. The present invention addresses this need by providing novel IL-15 targeted (e.g., bifunctional) proteins which steer IL-15 preferentially towards CD8+ T cells.

BRIEF SUMMARY OF THE INVENTION

The present invention provides bifunctional heterodimeric Fc fusion proteins that contain an IL-15/IL-15Rα complex and one or more antigen binding domains that bind to one or more antigens such as human CD8, human NKG2A, and human NKG2D. As used herein, the terms "bifunctional" and "targeted" can be used interchangeably.

In one aspect, provided herein is a bifunctional heterodimeric protein comprising a) an IL-15/IL-15Rα fusion protein comprising an IL-15Rα protein, an IL-15 protein, and a first Fc domain,
wherein the IL-15Rα protein is covalently attached to the N-terminus of the IL-15 protein using a first domain linker and the IL-15 protein is covalently attached to the N-terminus of the first Fc domain using a second domain linker, or
wherein the IL-15 protein is covalently attached to the N-terminus of the IL-15Rα protein using a first domain linker and the IL-15Rα protein is covalently attached to the N-terminus of the first Fc domain using a second domain linker; and b) an antigen binding domain monomer comprising a heavy chain comprising a VH-CH1-hinge-CH2-CH3 monomer, wherein VH is a variable heavy chain and CH2-CH3 is a second Fc domain, and a light chain comprising a variable light chain (VL) and a light constant domain (CL),
wherein the first and the second Fc domains have a set of amino acid substitutions selected from the group consisting of L368D/K370S S364K/E357Q; S364K/E357Q:L368D/K370S; L368D/K370S:S364K; L368E/K370S:S364K; T411T/K360E/Q362E:D401K; L368D/K370S:S364K/E357L and K370S:S364K/E357Q, according to EU numbering, and wherein the antigen binding domain monomer binds an antigen selected from the group consisting of human CD8, human NKG2A, and human NKG2D.

In some embodiments, the first and/or the second Fc domains have an additional set of amino acid substitutions comprising Q295E/N384D/Q418E/N421D, according to EU numbering. In some embodiments, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering. In various embodiments, the IL-15 protein has an amino acid sequence of SEQ ID NO: 1 (full-length human IL-15) or SEQ ID NO:2 (mature human IL-15), and the IL-15Rα protein has an amino acid sequence of SEQ ID NO: 3 (full-length human IL-15Rα) or SEQ ID NO:4 (sushi domain of human IL-15Rα). In various instances, the IL-15 protein and the IL-15Rα protein have a set of amino acid substitutions selected from the group consisting of E87C:D96/P97/C98; E87C:D96/C97/A98; V49C:540C; L52C:540C; E89C:K34C; Q48C:G38C; E53C:L42C; C42S:A37C; and L45C:A37C, respectively. The IL-15 protein may have one or more amino acid substitutions selected from the group consisting of N4D, D61N, N65D, and Q108E. In some cases, the IL-15 protein comprises the amino acid substitutions N4D/N65D or D30N/E64Q/N65D. The bifunctional heterodimeric protein may be XENP24114, XENP24115, XENP24116, XENP24531, XENP24532, XENP24533, XENP24534, XENP24736, XENP24917, XENP24918, XENP24919, XENP26223, XENP26224, XENP26227, XENP26229, XENP26585, XENP27145, or XENP27146.

In some embodiments, the heterodimeric protein described above can further comprise an antigen binding domain covalently attached to the N-terminus of said IL-15 protein or IL-15Rα protein using a domain linker, wherein said antigen binding domain comprises a second variable heavy chain domain and a second variable light chain domain and does not include an Fc domain. The bifunctional heterodimeric protein may be XENP24548.

In some embodiments, provided herein is a nucleic acid composition comprising a first nucleic acid encoding the IL-15/IL-15Rα fusion protein set forth above, a second nucleic acid encoding the antigen binding domain monomer set forth above, and optionally, a third nucleic acid encoding the antigen binding domain that is covalently attached to the N-terminus of the IL-15 protein or IL-15Rα protein using a domain linker. In some embodiments, provided herein is an expression vector composition comprising: a first expression vector comprising the first nucleic acid, a second expression vector comprising the second nucleic acid, and optionally, a third expression vector comprising the third nucleic acid. In some embodiments, a host cell comprises the expression vector composition. Also provided herein is a method of making any one of the bifunctional heterodimeric protein. The method comprises culturing the host cell set forth above under conditions wherein the bifunctional heterodimeric protein is expressed, and recovering said heterodimeric protein.

In yet another aspect, provided herein is a bifunctional heterodimeric protein comprising:
a) a fusion protein comprising a first protein domain and a first Fc domain, wherein the first protein domain is covalently attached to the N-terminus of the first Fc domain using a domain linker;
b) a second protein domain noncovalently attached to the first protein domain; and
c) an antigen binding domain monomer comprising a heavy chain comprising a VH-CH1-hinge-CH2-CH3 monomer, wherein VH is a variable heavy chain and CH2-CH3 is a second Fc domain, and a light chain comprising a variable light chain and a light constant domain;
wherein the first and the second Fc domains have a set of amino acid substitutions selected from the group consisting of L368D/K370S:S364K/E357Q; S364K/E357Q:L368D/K370S; L368D/K370S:S364K; L368E/K370S:S364K; T411T/K360E/Q362E:D401K; L368D/K370S:S364K/E357L and K370S:S364K/E357Q, according to EU numbering,
wherein the first protein domain comprises an IL-15Rα protein and the second protein domain comprises an IL-15 protein, or the first protein domain comprises an IL-15 protein and the second protein domain comprises an IL-15Rα protein, and wherein the antigen binding domain monomer binds an antigen selected from the group consisting of human CD8, human NKG2A, and human NKG2D.

In some embodiments, the IL-15Rα protein comprises a cysteine residue and the IL-15 protein comprises a cysteine residue, thereby forming a disulfide bond.

In some embodiments, the first and/or the second Fc domains have an additional set of amino acid substitutions comprising Q295E/N384D/Q418E/N421D, according to EU numbering. In some embodiments, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering. In various embodiments, the IL-15 protein has an amino acid sequence of SEQ ID NO: 1 (full-length human IL-15) or SEQ ID NO:2 (mature human IL-15), and the IL-15Rα protein has an amino acid sequence of SEQ ID NO: 3 (full-length human IL-15Rα) or SEQ ID NO:4 (sushi domain of human IL-15Rα). In various instances, the IL-15 protein and the IL-15Rα protein have a set of amino acid substitutions selected from the group consisting of E87C:D96/P97/C98; E87C:D96/C97/A98; V49C:540C; L52C:540C; E89C:K34C; Q48C:G38C; E53C:L42C; C42S:A37C; and L45C:A37C, respectively. The IL-15 protein may have one or more amino acid substitutions selected from the group consisting of N4D, D61N, N65D, and Q108E. In some cases, the IL-15 protein comprises the amino acid substitutions N4D/N65D or D30N/E64Q/N65D. The bifunctional heterodimeric protein may be XENP25137.

In some embodiments, the heterodimeric protein described above can further comprise an antigen binding domain covalently attached to the N-terminus of said IL-15 protein or IL-15Rα protein using one or more domain linker, wherein said antigen binding domain comprises a second variable heavy chain domain and a second variable light chain domain and does not include an Fc domain.

In some embodiments, provided herein is a nucleic acid composition comprising a first nucleic acid encoding the fusion protein set forth above, a second nucleic acid encoding the second protein domain set forth above, a third nucleic acid encoding the antigen binding domain set forth above, and optionally, a fourth nucleic acid encoding the antigen binding domain that is covalently attached to the N-terminus of the IL-15 protein and/or IL-15Rα protein using one or more domain linkers. In some embodiments, provided herein is an expression vector composition comprising: a first expression vector comprising the first nucleic acid, a second expression vector comprising the second nucleic acid, a third expression vector comprising the third nucleic acid, and optionally a fourth expression vector comprising the fourth nucleic acid. In some embodiments, a host cell comprises the expression vector composition. Also provided herein is a method of making any one of the bifunctional heterodimeric protein. The method comprises culturing the host cell set forth above under conditions wherein the bifunctional heterodimeric protein is expressed, and recovering said heterodimeric protein.

In yet another aspect, provided herein is a bifunctional heterodimeric protein comprising:
a) a first antigen binding domain monomer comprising a first heavy chain comprising a first VH-CH1-hinge-CH2-CH3 monomer, wherein VH is a first variable heavy chain and CH2-CH3 is a first Fc domain, and a first light chain comprising a first variable light chain and a first light constant domain;
b) a second antigen binding domain monomer comprising a second heavy chain comprising a second VH-CH1-hinge-CH2-CH3 monomer, wherein VH is a second variable heavy chain and CH2-CH3 is a second Fc domain, a second light chain comprising a second variable light chain and a second light constant domain, and a first protein domain that is covalently attached to the C-terminus of the second Fc domain using a first domain linker; and c) a second protein domain is attached or noncovalently attached to the first protein domain of the second antigen binding domain monomer, wherein the first protein domain is an IL-15Rα protein and the second protein domain is an IL-15Rα protein, or the first protein domain is an IL-15 protein and the second protein domain is an IL-15Rα protein, wherein the first and the second Fc domains have a set of amino acid substitutions selected from the group consisting of L368D/K370S:S364K/E357Q; S364K/E357Q:L368D/K370S; L368D/K370S:S364K; L368E/K370S:S364K; T411T/K360E/Q362E:D401K; L368D/K370S:S364K/E357L and K370S:S364K/E357Q, according to EU numbering, and wherein the first antigen binding domain monomer and the second antigen binding domain monomer binds an antigen selected from the group consisting of human CD8, human NKG2A, and human NKG2D.

In some embodiments, the first and/or the second Fc domains have an additional set of amino acid substitutions comprising Q295E/N384D/Q418E/N421D, according to EU numbering. In some embodiments, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering. In various embodiments, the IL-15 protein has an amino acid sequence of SEQ ID NO: 1 (full-length human IL-15) or SEQ ID NO:2 (mature human IL-15), and the IL-15Rα protein has an amino acid sequence of SEQ ID NO: 3 (full-length human IL-15Rα) or SEQ ID NO:4 (sushi domain of human IL-15Rα). In various instances, the IL-15 protein and the IL-15Rα protein have a set of amino acid substitutions selected from the group consisting of E87C:D96/P97/C98; E87C:D96/C97/A98; V49C:540C; L52C:540C; E89C:K34C; Q48C:G38C; E53C:L42C; C42S:A37C; and L45C:A37C, respectively. The IL-15 protein may have one or more amino acid substitutions selected from the group consisting of N4D, D61N, N65D, and Q108E. In some cases, the IL-15 protein comprises the amino acid substitutions N4D/N65D or D30N/E64Q/N65D. The bifunctional heterodimeric protein may be XENP24546.

In some embodiments, provided herein is a nucleic acid composition comprising a first nucleic acid encoding the first antigen binding domain monomer set forth above, a second nucleic acid encoding the second antigen binding domain monomer set forth above, and a third nucleic acid encoding the second protein domain set forth above. In some embodiments, provided herein is an expression vector composition comprising: a first expression vector comprising the first nucleic acid, a second expression vector comprising the second nucleic acid, and a third expression vector comprising the third nucleic acid. In some embodiments, a host cell comprises the expression vector composition. Also provided herein is a method of making any one of the bifunctional heterodimeric protein. The method comprises culturing the host cell set forth above under conditions wherein the bifunctional heterodimeric protein is expressed, and recovering said heterodimeric protein.

In one aspect, provided herein is a bifunctional heterodimeric protein comprising
a) an IL-15 fusion protein comprising a IL-15 protein, a first antigen binding domain, and a first Fc domain, wherein the first antigen binding domain is covalently attached to the N-terminus of the IL-15 protein using a first domain linker, the IL-15 protein is covalently attached to the N-terminus of the first Fc domain using a second domain linker, and the antigen binding domain comprises a first variable heavy chain domain and a first variable light chain domain and does not include an Fc domain; and
b) an IL-15Rα fusion protein comprising a IL-15Rα protein, a second antigen binding domain, and a second Fc domain,
wherein the second antigen binding domain is covalently attached to the N-terminus of the IL-15Rα protein using a third domain linker, the IL-15Rα protein is covalently attached to the N-terminus of the second Fc domain using a fourth domain linker, and the second antigen binding domain comprises a second variable heavy chain domain and a second variable light chain domain and does not include an Fc domain;
wherein the first and the second Fc domains have a set of amino acid substitutions selected from the group consisting of S267K/L368D/K370S:S267K/S364K/E357Q; S364K/E357Q:L368D/K370S; L368D/K370S:S364K; L368E/K370S:S364K; T411T/K360E/Q362E:D401K; L368D/K370S:S364K/E357L and K370S:S364K/E357Q, according to EU numbering, and
wherein the first antigen binding domain and the second antigen binding domain bind an antigen selected from the group consisting of human CD8, human NKG2A, and human NKG2D.

In some embodiments, the first and/or the second Fc domains have an additional set of amino acid substitutions comprising Q295E/N384D/Q418E/N421D, according to EU numbering. In some embodiments, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering. In various embodiments, the IL-15 protein has an amino acid sequence of SEQ ID NO: 1 (full-length human IL-15) or SEQ ID NO:2 (mature human IL-15), and the IL-15Rα protein has an amino acid sequence of SEQ ID NO: 3 (full-length human IL-15Rα) or SEQ ID NO:4 (sushi domain of human IL-15Rα). In various instances, the IL-15 protein and the IL-15Rα protein have a set of amino acid substitutions selected from the group consisting of E87C:D96/P97/C98; E87C:D96/C97/A98; V49C:540C; L52C:540C; E89C:K34C; Q48C:G38C; E53C:L42C; C42S:A37C; and L45C:A37C, respectively. The IL-15 protein may have one or more amino acid substitutions selected from the group consisting of N4D, D61N, N65D, and Q108E. In some cases, the IL-15 protein comprises the amino acid substitutions N4D/N65D or D30N/E64Q/N65D. The bifunctional heterodimeric protein may be XENP24547.

In some embodiments, provided herein is a nucleic acid composition comprising a first nucleic acid encoding the IL-15 fusion protein set forth above, and a second nucleic acid encoding the IL-15Rα fusion protein set forth above. In some embodiments, provided herein is an expression vector composition comprising: a first expression vector comprising the first nucleic acid and a second expression vector comprising the second nucleic acid. In some embodiments, a host cell comprises the expression vector composition. Also provided herein is a method of making any one of the bifunctional heterodimeric protein. The method comprises culturing the host cell set forth above under conditions wherein the bifunctional heterodimeric protein is expressed, and recovering said heterodimeric protein.

In another aspect, the present invention provides a bifunctional heterodimeric protein selected from the group consisting of XENP24114, XENP24115, XENP24116, XENP24531, XENP24532, XENP24533, XENP24534, XENP24543, XENP24546, XENP24547, XENP24548, XENP24736, XENP24917, XENP24918, XENP24919, XENP25137, XENP26223, XENP26224, XENP26227, XENP26229, XENP26585, XENP27145, and XENP27146.

In one aspect, the present invention provides a nucleic acid composition comprising one or more nucleic acids encoding a bifunctional heterodimeric protein selected from the group consisting of XENP24114, XENP24115, XENP24116, XENP24531, XENP24532, XENP24533, XENP24534, XENP24543, XENP24546, XENP24547, XENP24548, XENP24736, XENP24917, XENP24918, XENP24919, XENP25137, XENP26223, XENP26224, XENP26227, XENP26229, XENP26585, XENP27145, and XENP27146.

In yet another aspect, the present invention provides an expression vector composition comprising one or more expression vectors each comprising a nucleic acid such that the one or more expression vectors encode a bifunctional heterodimeric protein selected from the group consisting of XENP24114, XENP24115, XENP24116, XENP24531, XENP24532, XENP24533, XENP24534, XENP24543, XENP24546, XENP24547, XENP24548, XENP24736, XENP24917, XENP24918, XENP24919, XENP25137, XENP26223, XENP26224, XENP26227, XENP26229, XENP26585, XENP27145, and XENP27146.

Also provided is a host cell comprising any one of the nucleic acid composition described herein or a host cell comprising any one of the expression vector composition described herein.

In one aspect, the present invention provides a method or producing any of the bifunctional heterodimeric protein described herein. The method comprises (a) culturing the host cell described herein under suitable conditions wherein said bifunctional heterodimeric protein is expressed, and (b) recovering said protein.

In one aspect, the present invention provides a method of treating cancer in a patient in need thereof comprising administering a therapeutically effective amount of any one of the bifunctional heterodimeric proteins described herein to the patient.

Additional IL-15/IL-15Rα heterodimeric Fc fusion proteins are described in detail in, for example, in U.S. Ser. No. 62/684,143, filed Jun. 12, 2018, U.S. Ser. No. 62/659,563, filed Apr. 18, 2018, U.S. Ser. No. 62/408,655, filed Oct. 14, 2016, U.S. Ser. No. 62/416,087, filed Nov. 1, 2016, U.S. Ser. No. 62/443,465, filed Jan. 6, 2017, U.S. Ser. No. 62/477,926, filed Mar. 28, 2017, U.S. patent application Ser. No. 15/785, 401, filed on Oct. 16, 2017, and PCT International Application No. PCT/US2017/056829, filed on Oct. 16, 2017, which are expressly incorporated by reference in their entirety, with particular reference to the figures, legends, and claims therein.

Other aspects of the invention are provided herein.

BRIEF DESCRIPTION OF THE DRAWINGS

FIGS. 1A-1E depict useful pairs of Fc heterodimerization variant sets (including skew and pI variants). There are variants for which there are no corresponding "monomer 2" variants; these are pI variants which can be used alone on either monomer.

FIG. 2 depicts a list of isosteric variant antibody constant regions and their respective substitutions. pI_(−) indicates lower pI variants, while pI_(+) indicates higher pI variants. These can be optionally and independently combined with other heterodimerization variants of the inventions (and other variant types as well, as outlined herein.)

FIG. 3 depicts useful ablation variants that ablate FcγR binding (sometimes referred to as "knock outs" or "KO" variants). Generally, ablation variants are found on both monomers, although in some cases they may be on only one monomer.

FIGS. 4A-4E show useful embodiments of "non-cytokine" components of the IL-15/Rα-Fc fusion proteins of the invention.

FIGS. 5A-5F show particularly useful embodiments of "non-cytokine"/"non-Fv" components of the CD8-targeted, NKG2A-targeted, and NKG2D-targeted IL-15/Rα-Fc fusion proteins of the invention.

FIG. 6 depicts a number of exemplary variable length linkers for use in IL-15/Ra-Fc fusion proteins. In some embodiments, these linkers find use linking the C-terminus of IL-15 and/or IL-15Rα(sushi) to the N-terminus of the Fc region. In some embodiments, these linkers find use fusing IL-15 to the IL-15Rα(sushi).

FIG. 7 depict a number of charged scFv linkers that find use in increasing or decreasing the pI of heterodimeric antibodies that utilize one or more scFv as a component. The (+H) positive linker finds particular use herein. A single prior art scFv linker with single charge is referenced as "Whitlow", from Whitlow et al., Protein Engineering 6(8): 989-995 (1993). It should be noted that this linker was used for reducing aggregation and enhancing proteolytic stability in scFvs.

FIGS. 8A-8D shows the sequences of several useful IL-15/Rα-Fc format backbones based on human IgG1, without the cytokine sequences (e.g. the I1-15 and/or IL-15Rα (sushi)). It is important to note that these backbones can also find use in certain embodiments of CD8-targeted IL-15/Rα-Fc fusion proteins. Backbone 1 is based on human IgG1 (356E/358M allotype), and includes C220S on both chain, the S364K/E357Q:L368D/K370S skew variants, the Q295E/N384D/Q418E/N421D pI variants on the chain with L368D/K370S skew variants and the E233P/L234V/L235A/ G236del/S267K ablation variants on both chains. Backbone 2 is based on human IgG1 (356E/358M allotype), and includes C220S on both chain, the S364K:L368D/K370S skew variants, the Q295E/N384D/Q418E/N421D pI variants on the chain with L368D/K370S skew variants and the E233P/L234V/L235A/G236del/S267K ablation variants on both chains. Backbone 3 is based on human IgG1 (356E/ 358M allotype), and includes C220S on both chain, the S364K:L368E/K370S skew variants, the Q295E/N384D/ Q418E/N421D pI variants on the chain with L368E/K370S skew variants and the E233P/L234V/L235A/G236del/ S267K ablation variants on both chains. Backbone 4 is based on human IgG1 (356E/358M allotype), and includes C220S on both chain, the D401K:K360E/Q362E/T411E skew variants, the Q295E/N384D/Q418E/N421D pI variants on the chain with K360E/Q362E/T411E skew variants and the E233P/L234V/L235A/G236del/S267K ablation variants on both chains. Backbone 5 is based on human IgG1 (356D/ 358L allotype), and includes C220S on both chain, the S364K/E357Q:L368D/K370S skew variants, the Q295E/ N384D/Q418E/N421D pI variants on the chain with L368D/ K370S skew variants and the E233P/L234V/L235A/ G236del/S267K ablation variants on both chains. Backbone 6 is based on human IgG1 (356E/358M allotype), and includes C220S on both chain, the S364K/E357Q:L368D/ K370S skew variants, Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to 6 except the mutation is N297S. Alternative formats for backbones 6 and 7 can exclude the ablation variants E233P/L234V/L235A/G236del/S267K in both chains. Backbone 8 is based on human IgG4, and includes the S364K/E357Q:L368D/K370S skew variants, the Q295E/N384D/Q418E/N421D pI variants on the chain with L368D/K370S skew variants, as well as a S228P (EU numbering, this is S241P in Kabat) variant on both chains that ablates Fab arm exchange as is known in the art. Backbone 9 is based on human IgG2, and includes the S364K/E357Q:L368D/K370S skew variants, the Q295E/ N384D/Q418E/N421D pI variants on the chain with L368D/ K370S skew variants. Backbone 10 is based on human IgG2, and includes the S364K/E357Q:L368D/K370S skew variants, the Q295E/N384D/Q418E/N421D pI variants on the chain with L368D/K370S skew variants as well as a S267K variant on both chains. Backbone 11 is identical to backbone 1, except it includes M428L/N434S Xtend mutations. Backbone 12 is based on human IgG1 (356E/358M allotype), and includes C220S on both identical chain, the E233P/L234V/L235A/G236del/S267K ablation variants on both identical chains. Backbone 13 is based on human IgG1 (356E/358M allotype), and includes C220S on both chain, the S364K/E357Q:L368D/K370S skew variants, the P217R/ P229R/N276K pI variants on the chain with S364K/E357Q skew variants and the E233P/L234V/L235A/G236del/ S267K ablation variants on both chains.

Figure 14:
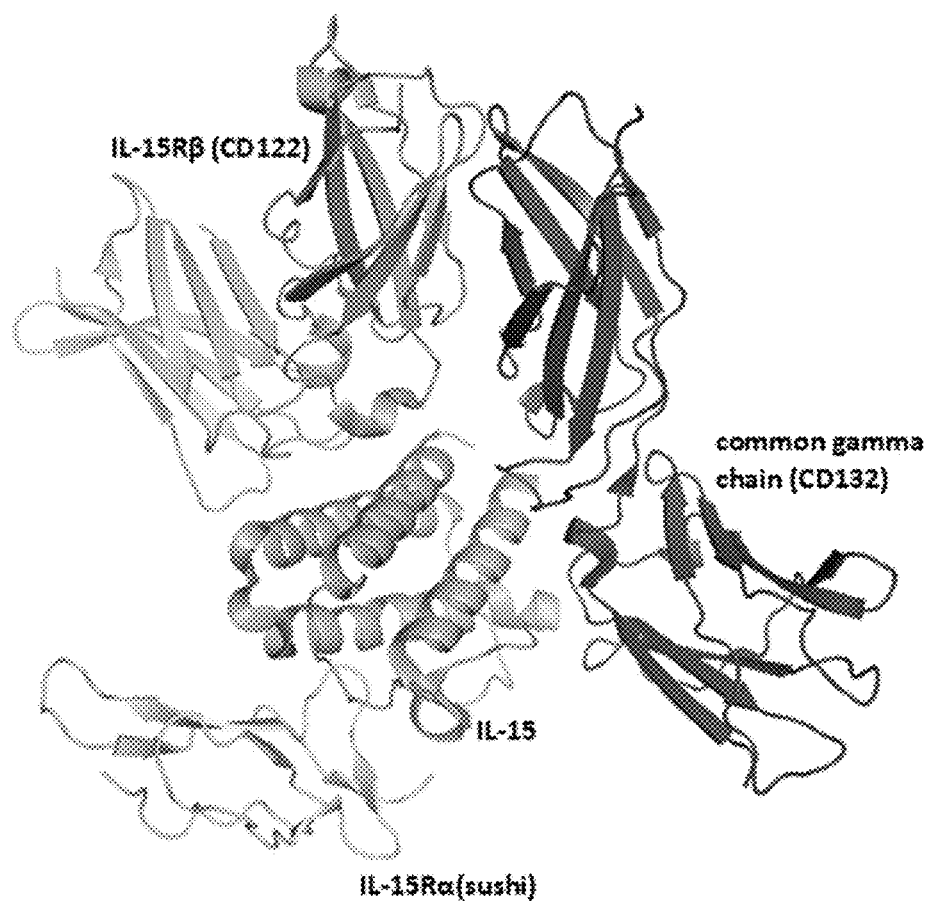

As will be appreciated by those in the art and outlined below, these sequences can be used with any IL-15 and IL-15Rα(sushi) pairs outlined herein, including but not limited to IL-15/Rα-heteroFc, ncIL-15/Rα, and scIL-15/Rα, as schematically depicted in FIGS. 16A-16G and 30A-30D. Additionally, any IL-15 and/or IL-15Rα(sushi) variants can be incorporated into these FIGS. 8A-8D backbones in any combination.

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 9 shows the sequences of several useful CD8-targeted IL-15/Rα-Fc fusion format backbones based on human IgG1, without the cytokine sequences (e.g. the I1-15 and/or IL-15Rα(sushi)) or VH, and further excluding light chain backbones which are depicted in FIG. 10. Backbone 1 is based on human IgG1 (356E/358M allotype), and includes the S364K/E357Q:L368D/K370S skew variants, C220S and the Q295E/N384D/Q418E/N421D pI variants on the chain with L368D/K370S skew variants and the E233P/ L234V/L235A/G236del/S267K ablation variants on both chains. Backbone 2 is based on human IgG1 (356E/358M allotype), and includes the S364K/E357Q: L368D/K370S skew variants, the N208D/Q295E/N384D/Q418E/N421D pI variants on the chain with L368D/K370S skew variants, C220S in the chain with S364K/E357Q variants, and the E233P/L234V/L235A/G236del/S267K ablation variants on both chains. Backbone 3 is based on human IgG1 (356E/ 358M allotype), and includes the S364K/E357Q: L368D/ K370S skew variants, the N208D/Q295E/N384D/Q418E/ N421D pI variants on the chains with L368D/K370S skew variants, the Q196K/I199T/P217R/P228R/N276K pI variants on the chains with S364K/E357Q variants, and the E233P/L234V/L235A/G236del/S267K ablation variants on both chains.

In certain embodiments, these sequences can be of the 356D/358L allotype. In other embodiments, these sequences can include either the N297A or N297S substitutions. In some other embodiments, these sequences can include the M428L/N434S Xtend mutations. In yet other embodiments, these sequences can instead be based on human IgG4, and include a S228P (EU numbering, this is S241P in Kabat) variant on both chains that ablates Fab arm exchange as is known in the art. In yet further embodiments, these sequences can instead be based on human IgG2. Further, these sequences may instead utilize the other skew variants, pI variants, and ablation variants depicted in FIGS. 1A-1E, 2, and 3.

As will be appreciated by those in the art and outlined below, these sequences can be used with any IL-15 and IL-15Rα(sushi) pairs outlined herein, including but not limited to scIL-15/Rα, ncIL-15/Rα, and dsIL-15Rα, as schematically depicted in FIG. 70. Further as will be appreciated by those in the art and outlined below, any IL-15 and/or IL-15Rα(sushi) variants can be incorporated in these backbones. Furthermore, as will be appreciated by those in the art and outlined below, these sequences can be used with any VH and VL pairs outlined herein, including either a scFv or a Fab.

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure. It should also be noted that the backbones depicted herein are also suitable for use in the NKG2A-targeted and NKG2D-targeted IL-15/Rα-Fc fusion proteins of the invention.

FIG. 10 depicts the "non-Fv" backbone of light chains (i.e. constant light chain) which find use in CD8-targeted, NKG2A-targeted, and NKG2D-targeted IL-15/Rα-Fc fusion proteins of the invention.

FIG. 11 depicts the sequences for XENP15074, an anti-RSV mAb based on the variable regions of motavizumab (Numax®), which is a control used in a number of examples described herein. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 12 depicts the sequences for XENP16432, an anti-PD-1 mAb based on the variable regions of nivolumab (Opdivo®). The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 13 depicts the sequences for XENP26007, an "RSV-targeted" IL-15/Rα-Fc fusion used as control in many of the examples described herein. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

FIG. 14 depicts the structure of IL-15 in complex with its receptors IL-15Rα (CD215), IL-15Rβ (CD122), and the common gamma chain (CD132).

FIG. 15A-15B depicts the sequences for IL-15 and its receptors.

FIGS. 16A-16G depict several formats for the IL-15/Rα-Fc fusion proteins of the present invention. IL-15Rα Heterodimeric Fc fusion or "IL-15/Rα-heteroFc" (FIG. 16A) comprises IL-15 recombinantly fused to one side of a heterodimeric Fc and IL-15Rα(sushi) recombinantly fused to the other side of a heterodimeric Fc. The IL-15 and IL-15Rα(sushi) may have a variable length Gly-Ser linker between the C-terminus and the N-terminus of the Fc region. Single-chain IL-15/Rα-Fc fusion or "scIL-15/Rα-Fc" (FIG. 16B) comprises IL-15Rα(sushi) fused to IL-15 by a variable length linker (termed a "single-chain" IL-15/IL-15Rα(sushi) complex or "scIL-15/Rα") which is then fused to the N-terminus of a heterodimeric Fc-region, with the other side of the molecule being "Fc-only" or "empty Fc". Non-covalent IL-15/Rα-Fc or "ncIL-15/Rα-Fc" (FIG. 16C) comprises IL-15Rα(sushi) fused to a heterodimeric Fc region, while IL-15 is transfected separately so that a non-covalent IL-15/Rα complex is formed, with the other side of the molecule being "Fc-only" or "empty Fc". Bivalent non-covalent IL-15/Rα-Fc fusion or "bivalent ncIL-15/Rα-Fc" (FIG. 16D) comprises IL-15Rα(sushi) fused to the N-terminus of a homodimeric Fc region, while IL-15 is transfected separately so that a non-covalent IL-15/Rα complex is formed. Bivalent single-chain IL-15/Rα-Fc fusion or "bivalent scIL-15/Rα-Fc" (FIG. 16E) comprises IL-15 fused to IL-15Rα(sushi) by a variable length linker (termed a "single-chain" IL-15/IL-15Rα(sushi) complex or "scIL-15/Rα") which is then fused to the N-terminus of a homodimeric Fc-region. Fc-non-covalent IL-15/Rα fusion or "Fc-ncIL-15/Rα" (FIG. 16F) comprises IL-15Rα(sushi) fused to the C-terminus of a heterodimeric Fc region, while IL-15 is transfected separately so that a non-covalent IL-15/Rα complex is formed, with the other side of the molecule being "Fc-only" or "empty Fc". Fc-single-chain IL-15/Rα fusion or "Fc-scIL-15/Rα" (FIG. 16G) comprises IL-15 fused to IL-15Rα(sushi) by a variable length linker (termed a "single-chain" IL-15/IL-15Rα(sushi) complex or "scIL-15/Rα") which is then fused to the C-terminus of a heterodimeric Fc region, with the other side of the molecule being "Fc-only" or "empty Fc".

FIG. 17 depicts sequences of XENP20818 and XENP21475, illustrative IL-15/Rα-Fc fusion proteins of the "IL-15/Rα-heteroFc" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

FIG. 18 depicts sequences of XENP21478 and XENP21993, illustrative IL-15/Rα-Fc fusion protein of the "scIL-15/Rα-Fc" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

FIGS. 19A-19B depicts sequences of XENP21479, XENP22366 and XENP24348, illustrative IL-15/Rα-Fc fusion proteins of the "ncIL-15/Rα-Fc" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

FIG. 20 depicts sequences of XENP21978, an illustrative IL-15/Rα-Fc fusion protein of the "bivalent ncIL-15/Rα-Fc" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

FIG. 21 depicts sequences of an illustrative IL-15/Rα-Fc fusion protein of the "bivalent scIL-15/Rα-Fc" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

FIG. 22 depicts sequences of XENP22637 and XENP22638, illustrative IL-15/Rα-Fc fusion proteins of the "Fc-ncIL-15/Rα" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

FIG. 23 depicts sequences of an illustrative IL-15/Rα-Fc fusion protein of the "Fc-scIL-15/Rα" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

Figure 24A:
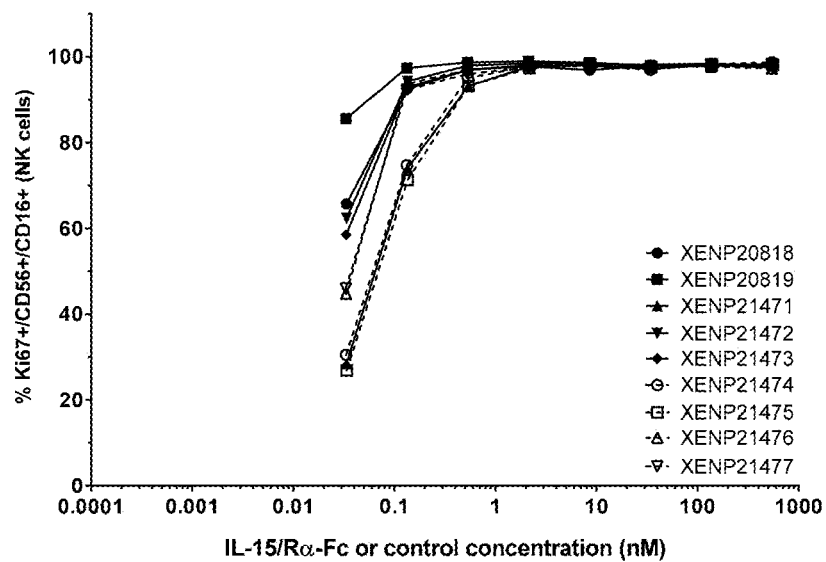
Figure 24B:
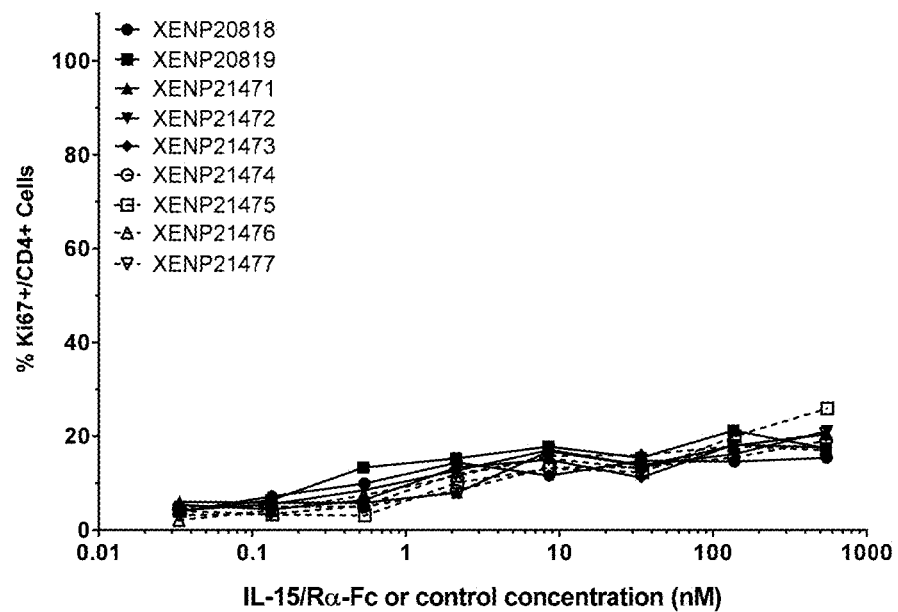
Figure 24C:
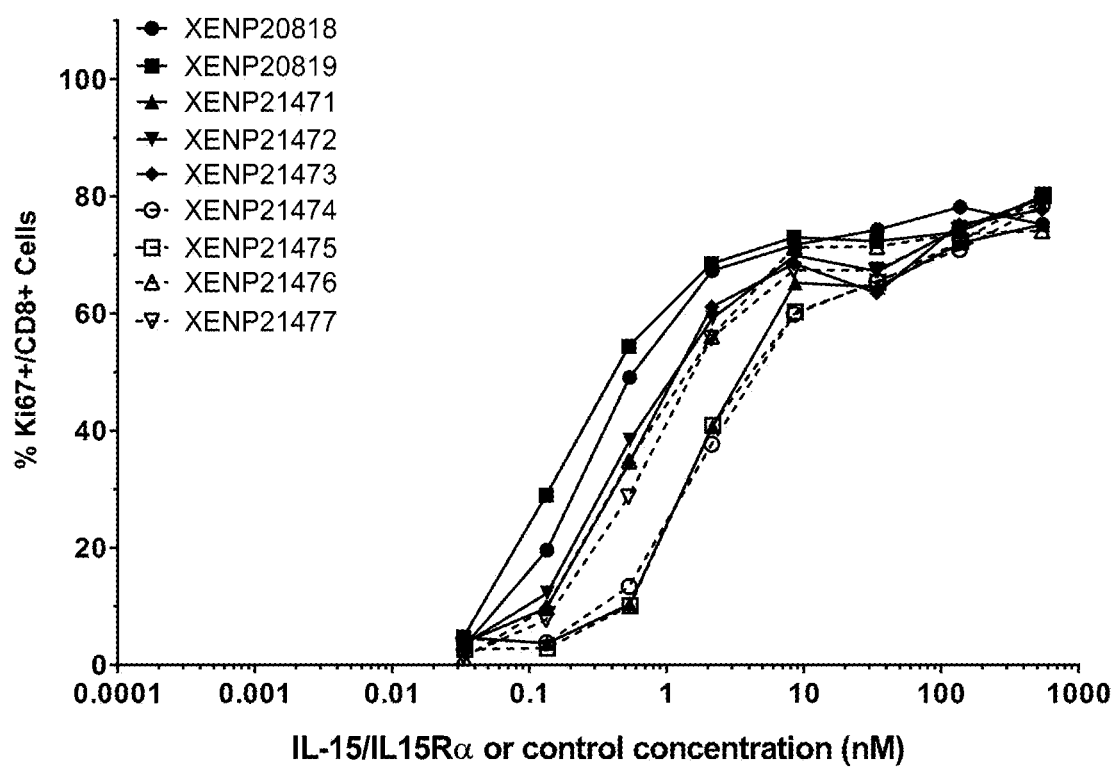

FIGS. 24A-24C depict the induction of (FIG. 24A) NK (CD56+/CD16+) cells, (FIG. 24B) CD4+ T cells, and (FIG. 24C CD8+ T cells proliferation by illustrative IL-15/Rα-Fc fusion proteins of Format A with different linker lengths based on Ki67 expression as measured by FACS.

Figure 25A:
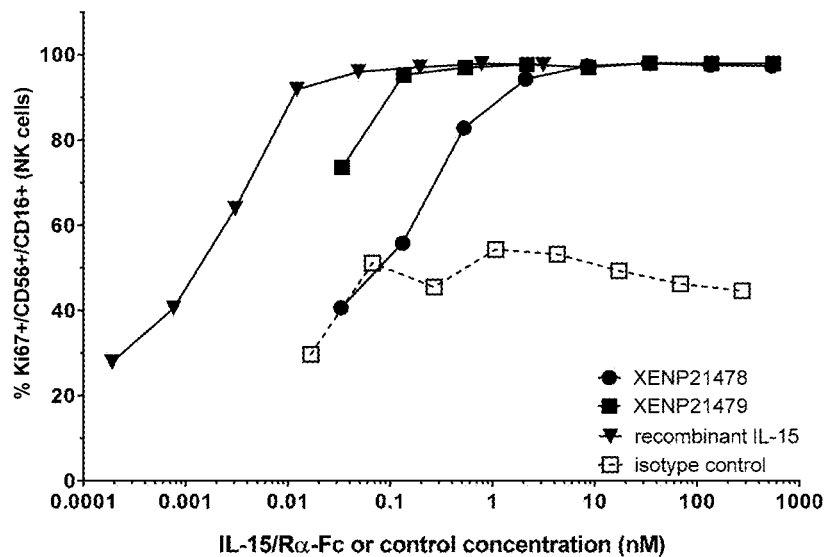
Figure 25B:
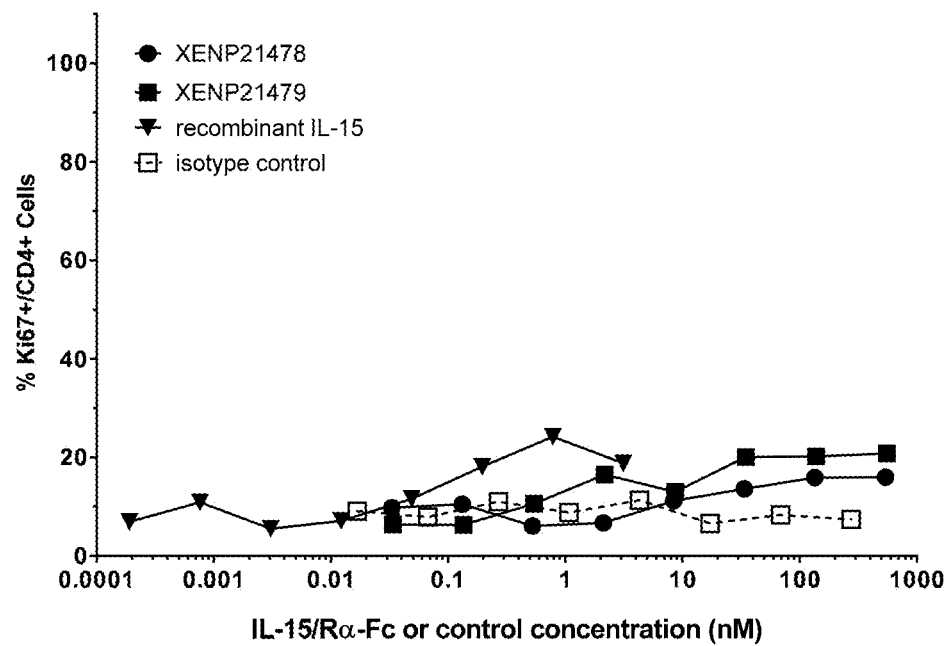
Figure 25C:
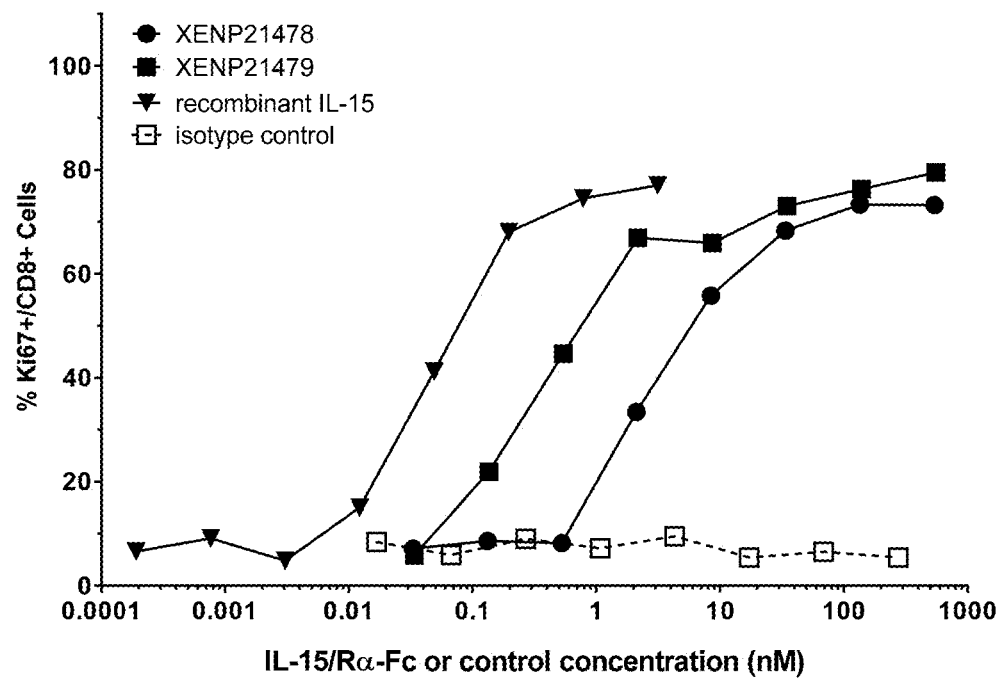

FIGS. 25A-25C depict the induction of (FIG. 25A) NK (CD56+/CD16+) cells, (FIG. 25B) CD4+ T cells, and (FIG. 25C) CD8+ T cells proliferation by illustrative IL-15/Rα-Fc fusion proteins of scIL-15/Rα-Fc format (XENP21478) and ncIL-15/Rα-Fc format (XENP21479) based on Ki67 expression as measured by FACS.

Figure 26:
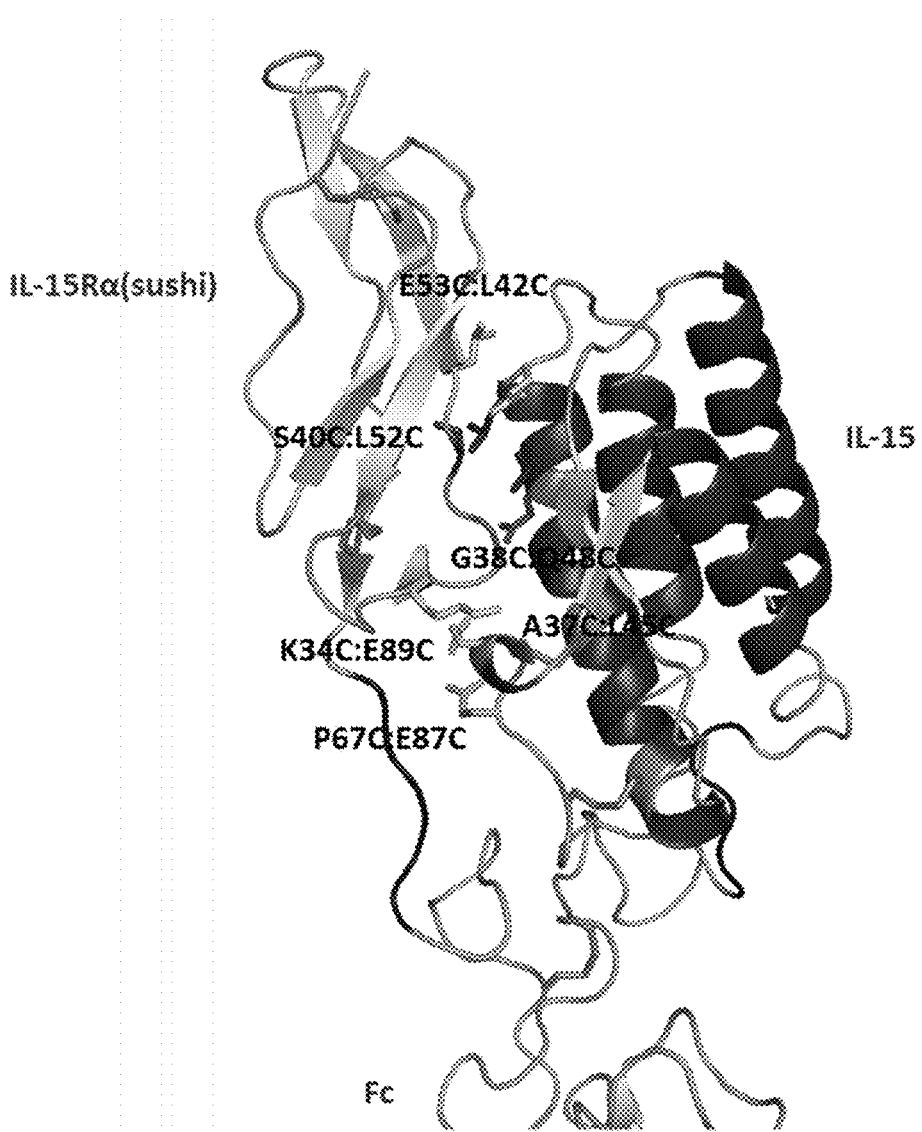

FIG. 26 depicts a structural model of the IL-15/Rα heterodimer showing locations of engineered disulfide bond pairs.

FIG. 27 depicts sequences for illustrative IL-15Rα(sushi) variants engineered with additional residues at the C-terminus to serve as a scaffold for engineering cysteine residues.

FIG. 28 depicts sequences for illustrative IL-15 variants engineered with cysteines in order to form covalent disulfide bonds with IL-15Rα(sushi) variants engineered with cysteines.

FIG. 29 depicts sequences for illustrative IL-15Rα(sushi) variants engineered with cysteines in order to form covalent disulfide bonds with IL-15 variants engineered with cysteines.

FIGS. 30A-30D depict additional formats for the IL-15/Rα-Fc fusion proteins of the present invention with engineered disulfide bonds. Disulfide-bonded IL-15/Rα heterodimeric Fc fusion or "dsIL-15/Rα-heteroFc" (FIG. 30A) is the same as "IL-15/Rα-heteroFc", but wherein IL-15Rα (sushi) and IL-15 are further covalently linked as a result of engineered cysteines. Disulfide-bonded IL-15/Rα Fc fusion or "dsIL-15/Rα-Fc" (FIG. 30B) is the same as "ncIL-15/Rα-Fc", but wherein IL-15Rα(sushi) and IL-15 are further covalently linked as a result of engineered cysteines. Bivalent disulfide-bonded IL-15/Rα-Fc or "bivalent dsIL-15/Rα-Fc" (FIG. 30C) is the same as "bivalent ncIL-15/Rα-Fc", but wherein IL-15Rα(sushi) and IL-15 are further covalently linked as a result of engineered cysteines. Fc-disulfide-bonded IL-15/Rα fusion or "Fc-dsIL-15/Rα" (FIG. 30D) is the same as "Fc-ncIL-15/Rα", but wherein IL-15Rα(sushi) and IL-15 are further covalently linked as a result of engineered cysteines.

FIG. 31A-31B depict sequences of XENP22013, XENP22014, XENP22015, and XENP22017, illustrative IL-15/Rα-Fc fusion protein of the "dsIL-15/Rα-heteroFc" format. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIGS. 32A-32B depict sequences of XENP22357, XENP22358, XENP22359, XENP22684, and XENP22361, illustrative IL-15/Rα-Fc fusion proteins of the "dsIL-15/Rα-Fc" format. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIG. 33 depicts sequences of XENP22634, XENP22635, XENP22636 and XENP22687, illustrative IL-15/Rα-Fc fusion proteins of the "bivalent dsIL-15/Rα-Fc" format. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIG. 34 depicts sequences of XENP22639 and XENP22640, illustrative IL-15/Rα-Fc fusion proteins of the "Fc-dsIL-15/Rα" format. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

Figure 35:
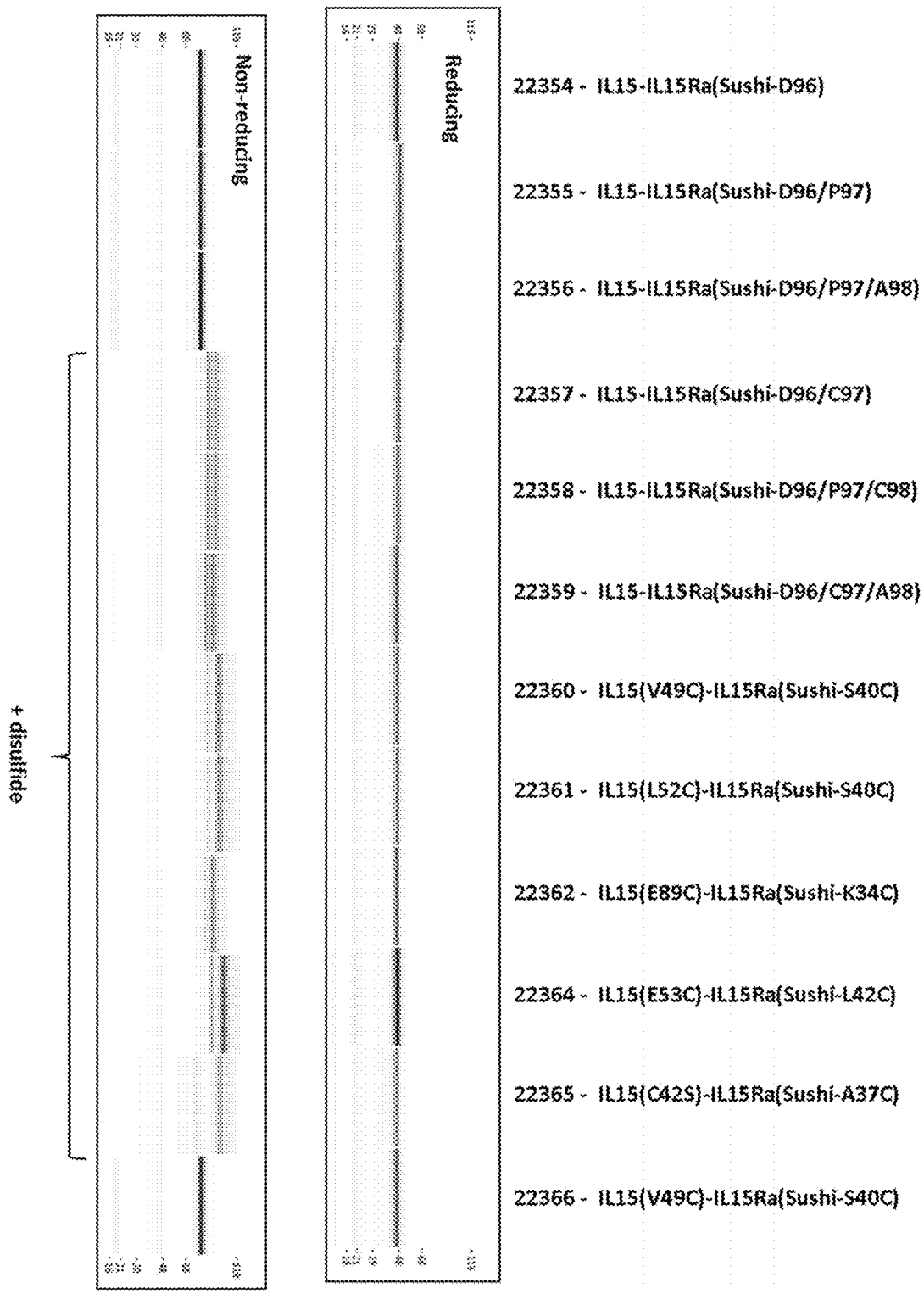

FIG. 35 depicts the purity and homogeneity of illustrative IL-15/Rα-Fc fusion proteins with and without engineered disulfide bonds as determined by CEF.

Figure 36A:
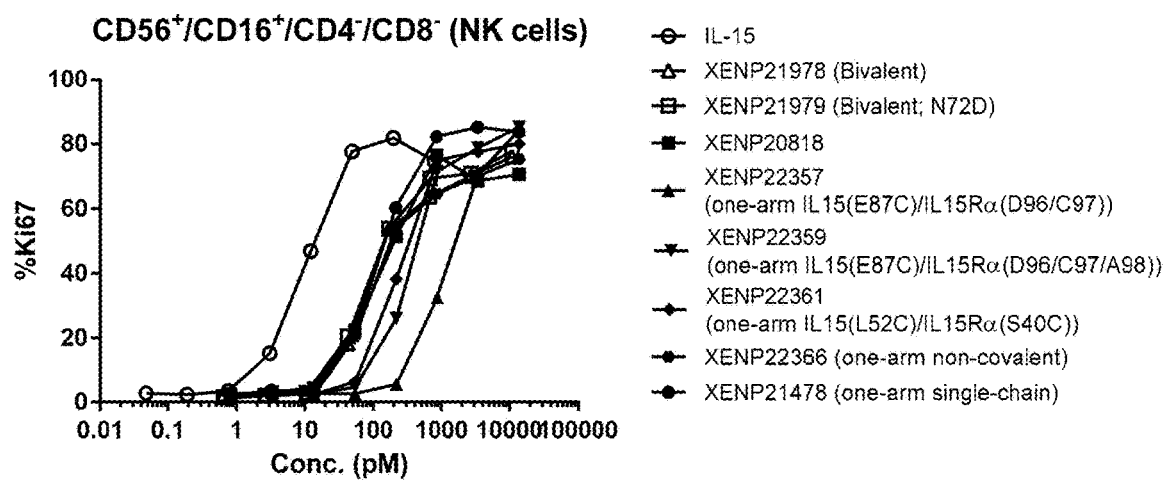
Figure 36B:
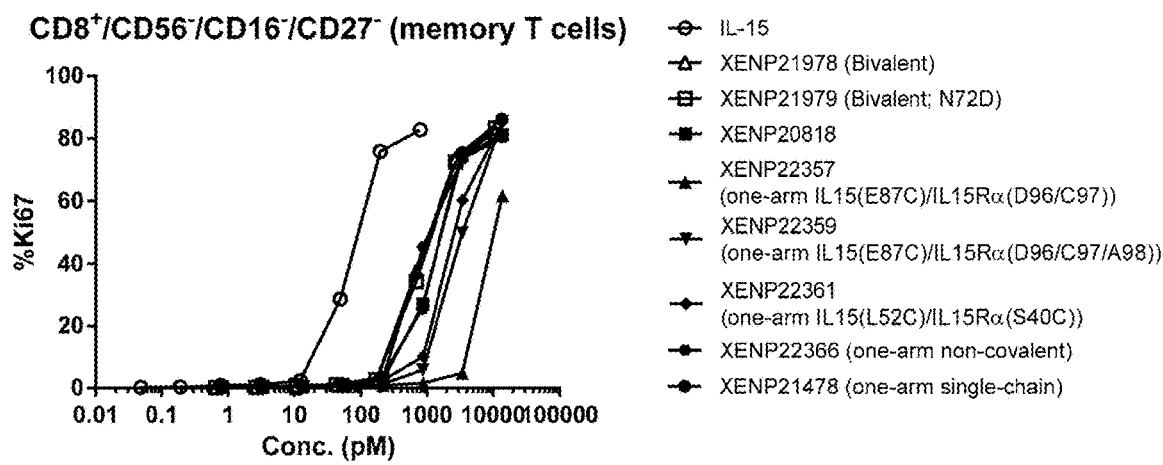
Figure 36C:
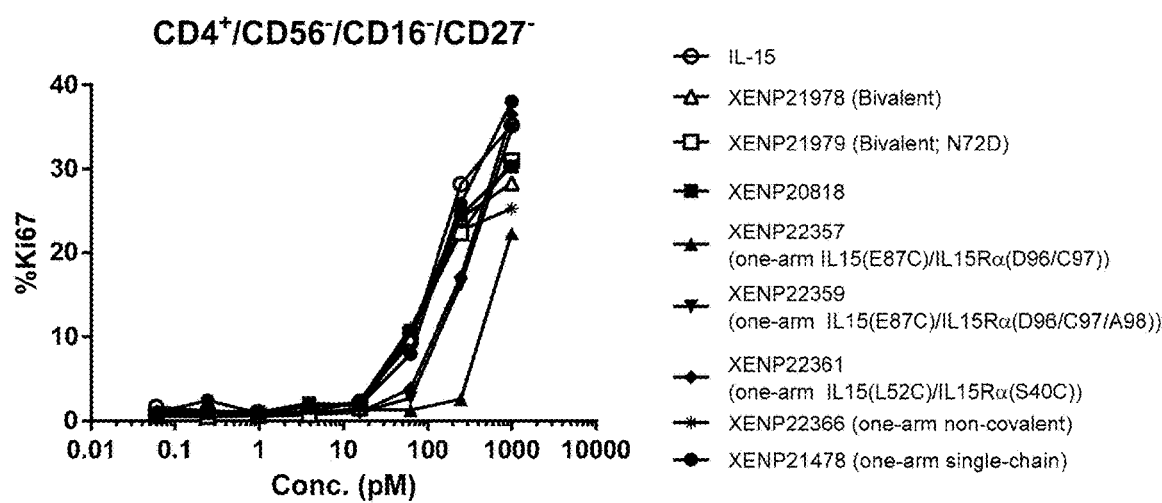

FIGS. 36A-36C depicts the induction of (FIG. 36A) NK (CD56+/CD16+) cell, (FIG. 36B) CD8+ T cell, and (FIG. 36C) CD4+ T cell proliferation by illustrative IL-15/Rα-Fc fusion proteins with and without engineered disulfide bonds based on Ki67 expression as measured by FACS.

Figure 37:
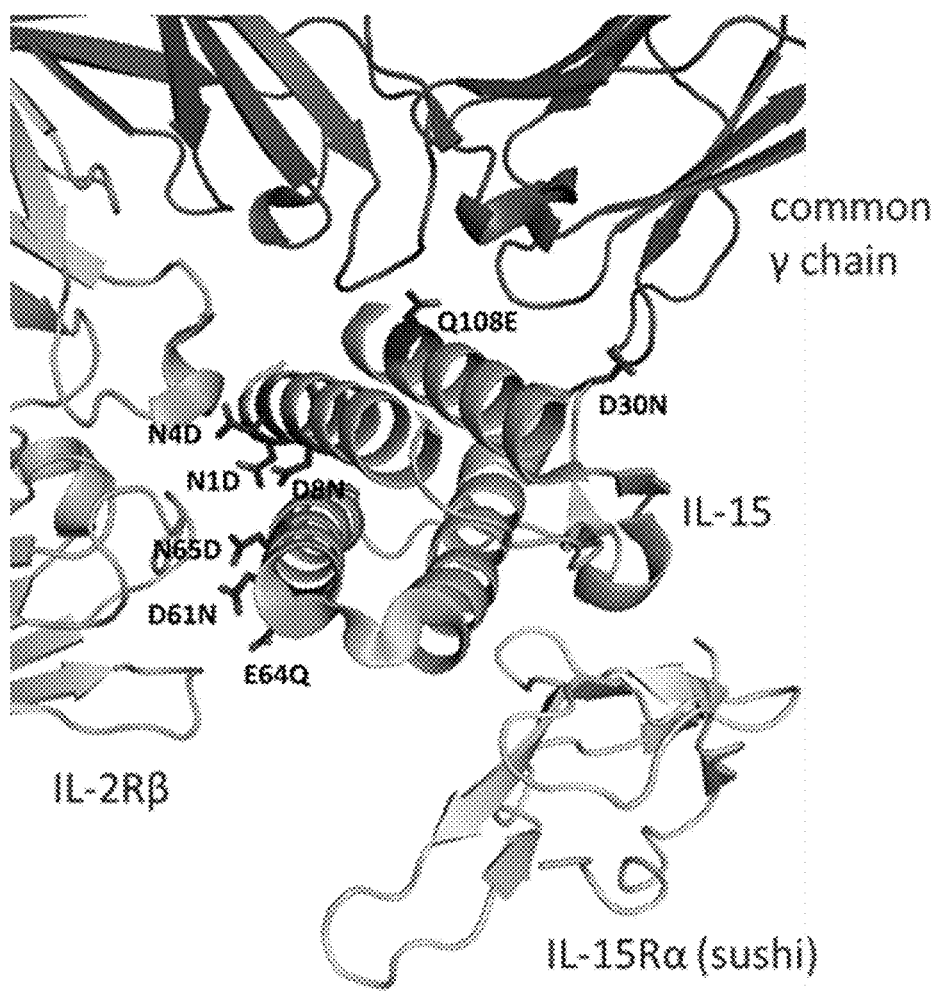

FIG. 37 depicts the structure of IL-15 complexed with IL-15Rα, IL-2Rβ, and common gamma chain. Locations of substitutions designed to reduce potency are shown.

FIGS. 38A-38C depict sequences for illustrative IL-15 variants engineered for reduced potency. Included within each of these variant IL-15 sequences are sequences that are 90, 95, 98 and 99% identical (as defined herein) to the recited sequences, and/or contain from 1, 2, 3, 4, 5, 6, 7, 8, 9 or 10 additional amino acid substitutions. In a non-limiting example, the recited sequences may contain additional amino acid modifications such as those contributing to formation of covalent disulfide bonds as described in Example 3B.

FIGS. 39A-39E depict sequences of XENP22821, XENP22822, XENP23343, XENP23554, XENP23557, XENP23561, XENP24018, XENP24019, XENP24045, XENP24051, XENP24052, and XENP24306, illustrative IL-15/Rα-Fc fusion proteins of the "IL-15/Rα-heteroFc" format engineered for reduced potency. IL-15 and IL-15Rα (sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIGS. 40A-40d depicts sequences of XENP24013, XENP24014, XENP24015, XENP24050, XENP24294, XENP24475, XENP24476, XENP24478, XENP24479, and XENP24481, illustrative IL-15/Rα-Fc fusion proteins of the "scIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIGS. 41A-41B depict sequences of XENP24349, XENP24890, and XENP25138, illustrative IL-15/Rα-Fc fusion proteins of the "ncIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIG. 42 depicts sequences of XENP22801 and XENP22802, illustrative ncIL-15/Ra heterodimers engineered for reduced potency. It is important to note that these sequences were generated using polyhistidine (Hisx6 or HHHHHH (SEQ ID NO: 5)) C-terminal tags at the C-terminus of IL-15Rα(sushi).

FIG. 43 depicts sequences of XENP24342, an illustrative IL-15/Rα-Fc fusion protein of the "bivalent ncIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIG. 44 depicts sequences of XENP23472 and XENP23473, illustrative IL-15/Rα-Fc fusion proteins of the "dsIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

Figure 45A:
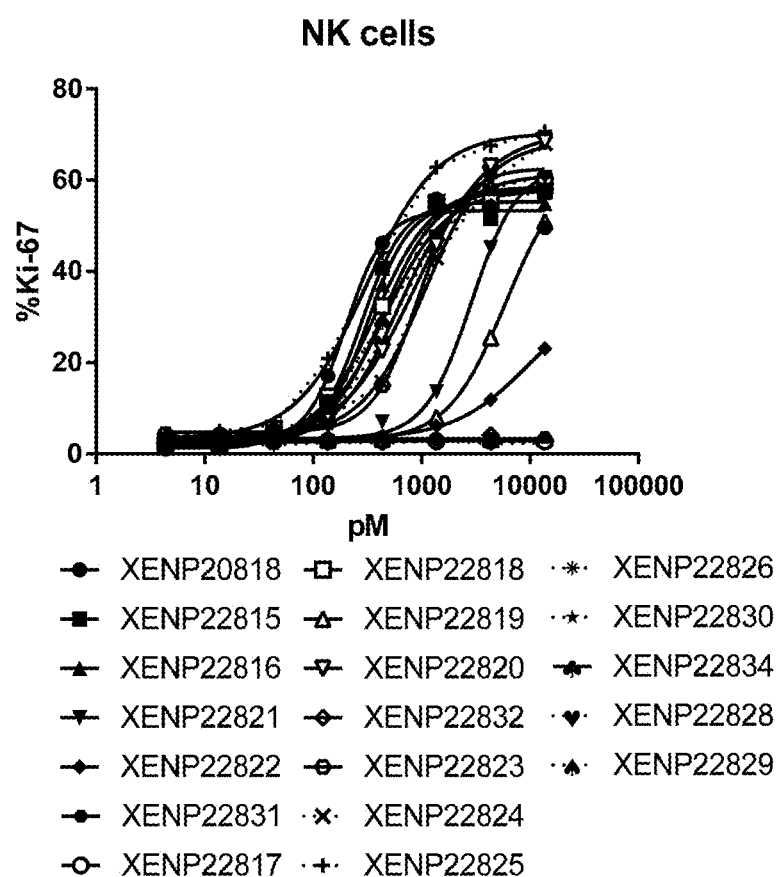
Figure 45B:
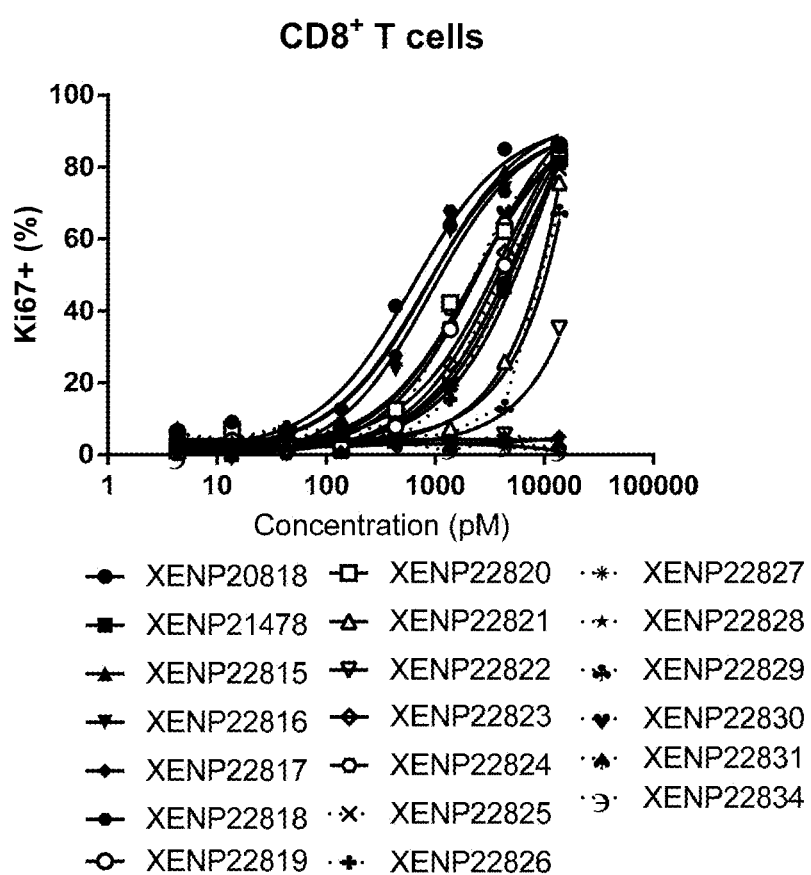
Figure 45C:
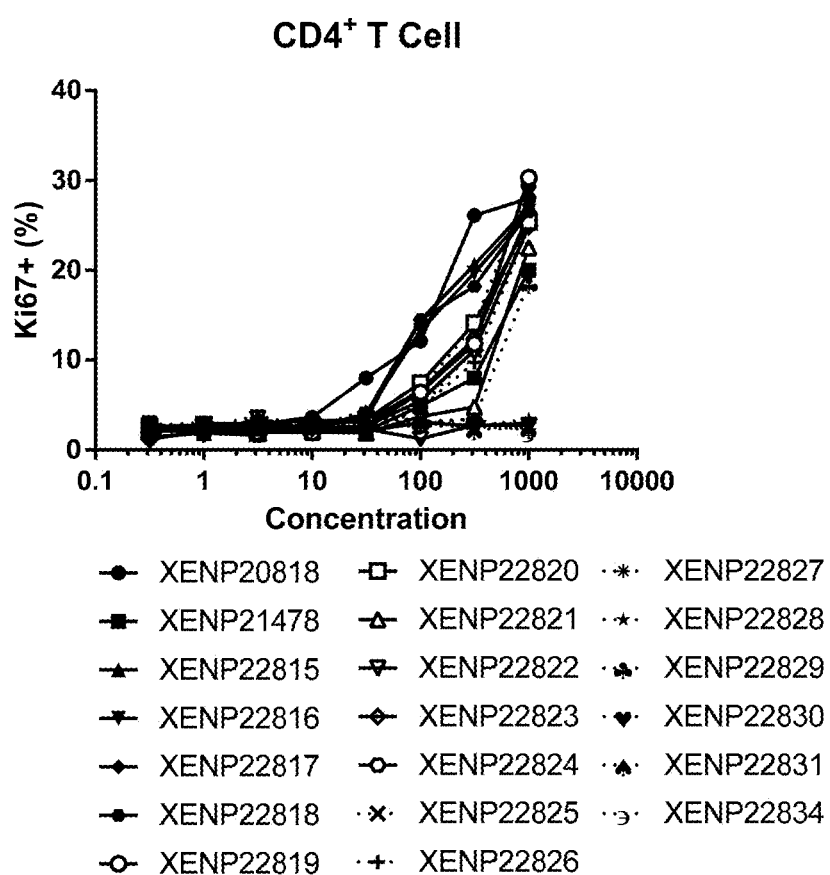

FIGS. 45A-45C depict the induction of A) NK cell, B) CD8+ (CD45RA−) T cell, and C) CD4+(CD45RA−) T cell proliferation by variant IL-15/Rα-Fc fusion proteins based on Ki67 expression as measured by FACS.

FIG. 46 depicts EC50 for induction of NK and CD8+ T cells proliferation by variant IL-15/Rα-Fc fusion proteins, and fold reduction in EC50 relative to XENP20818.

Figure 47A:
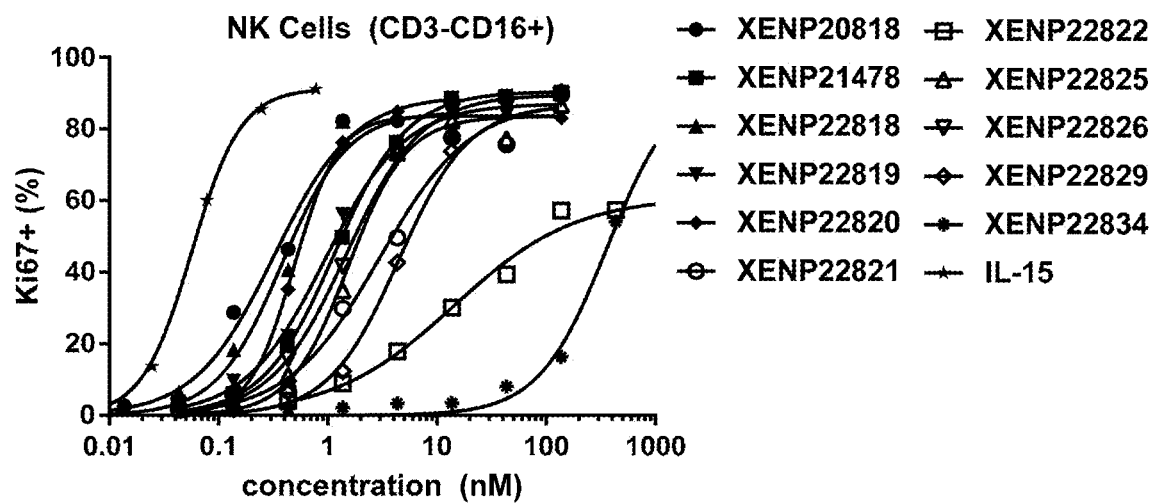
Figure 47B:
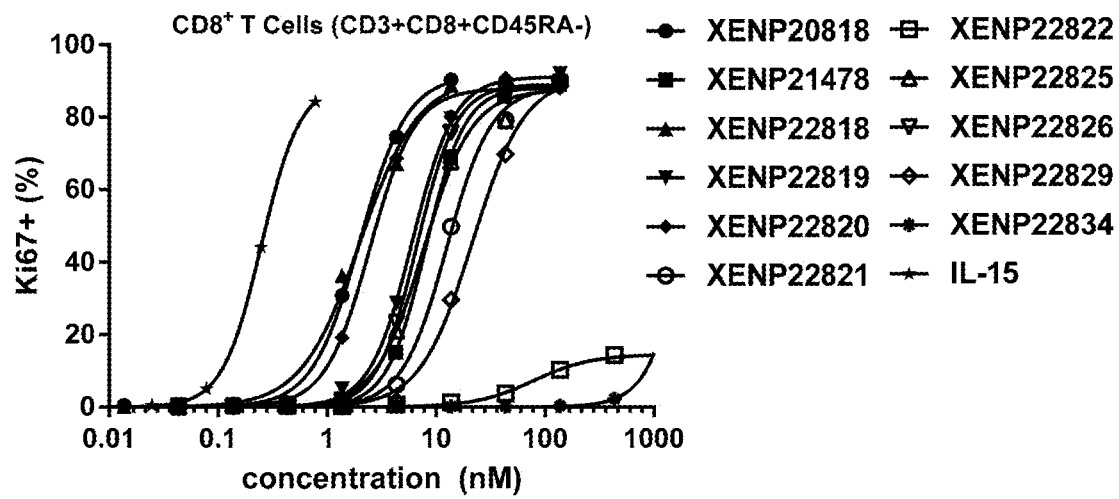
Figures 47C, 47D:
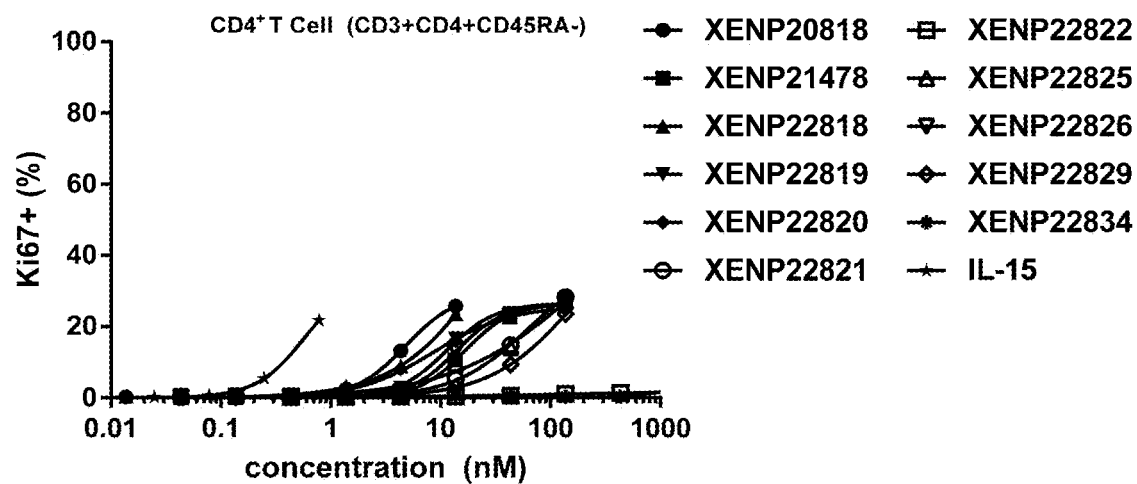

FIGS. 47A-47D depict cell proliferation in human PBMCs incubated for four days with the indicated variant IL-15/Rα-Fc fusion proteins. FIGS. 47A-47C show the percentage of proliferating NK cells (CD3-CD16+) (FIG. 47A), CD8+ T cells (CD3+CD8+CD45RA−) (FIG. 47B) and CD4+ T cells (CD3+CD4+CD45RA−) (FIG. 47C). FIG. 47D shows the fold change in EC50 of various IL15/IL15Rα Fc heterodimers relative to control (XENP20818).

FIGS. 48A-48B depict CD69 and CD25 expression before (FIG. 55A) and after (FIG. 55B) incubation of human PBMCs with XENP22821.

Figure 49A:
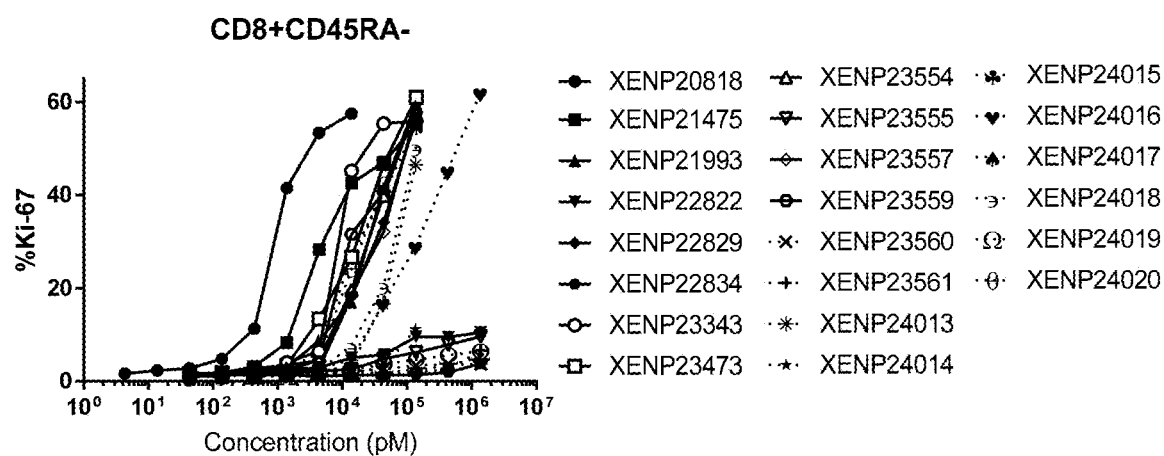
Figure 49B:
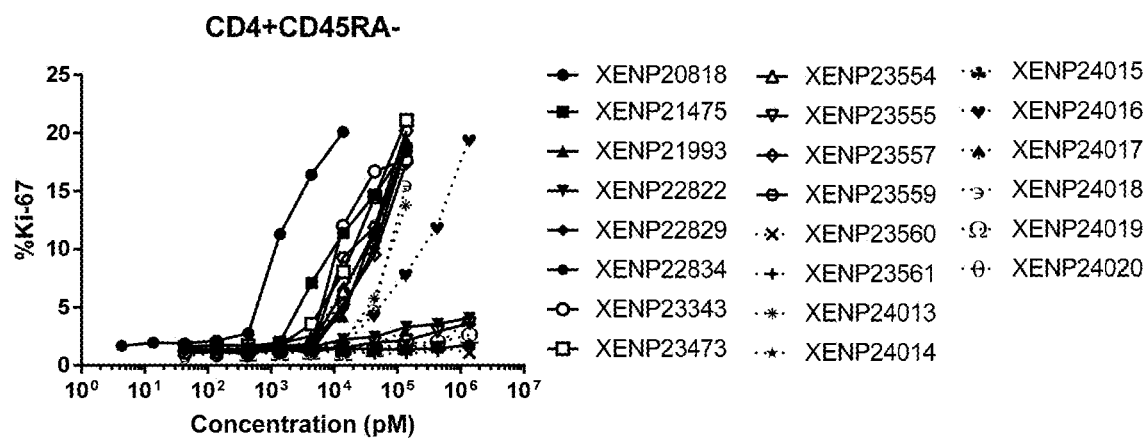
Figure 49C:
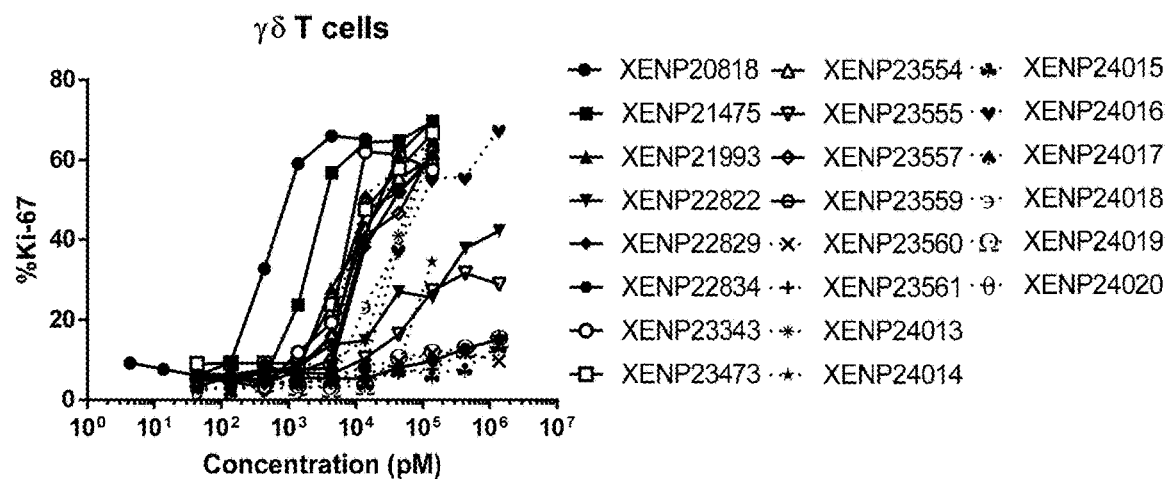
Figure 49D:
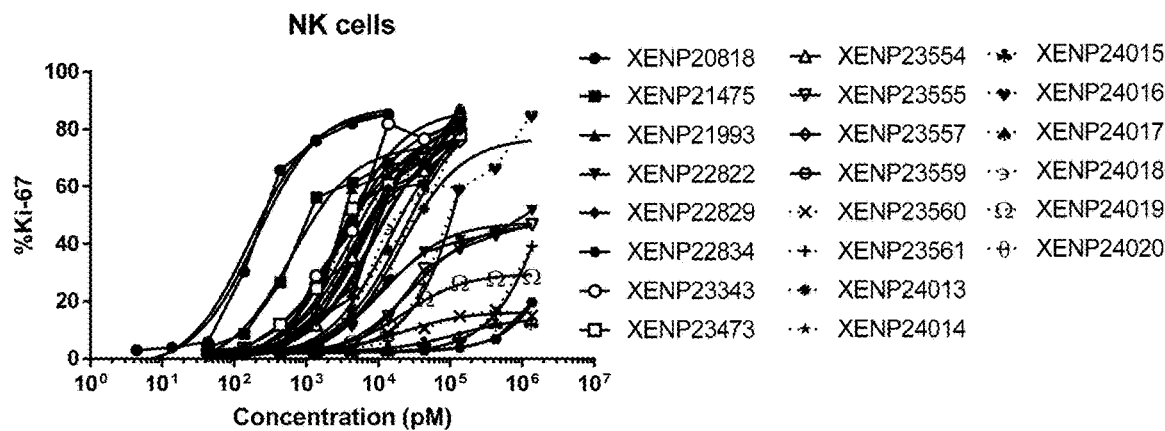
Figure 54A:
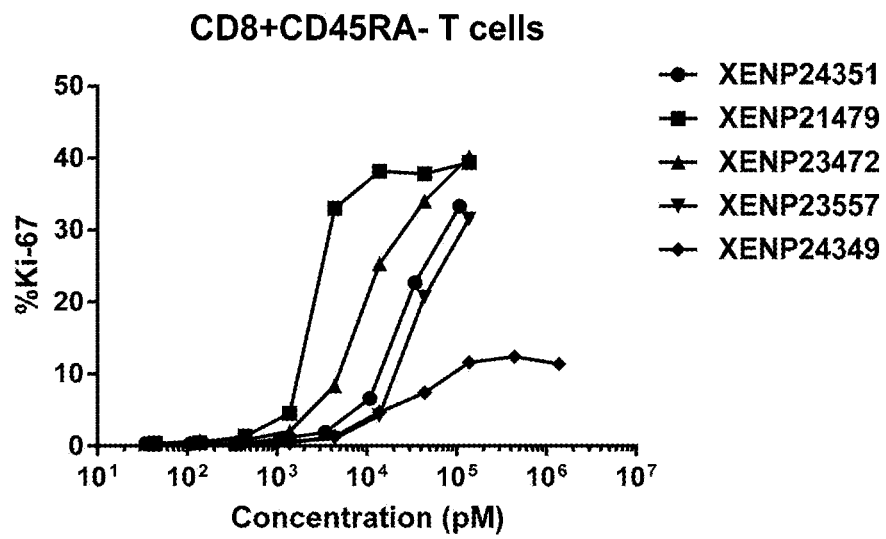
Figure 54B:
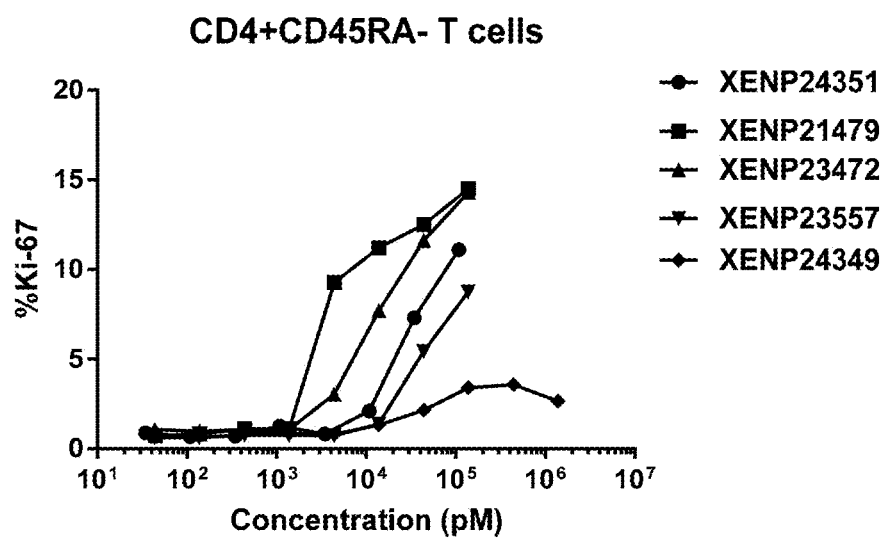
Figure 54C:
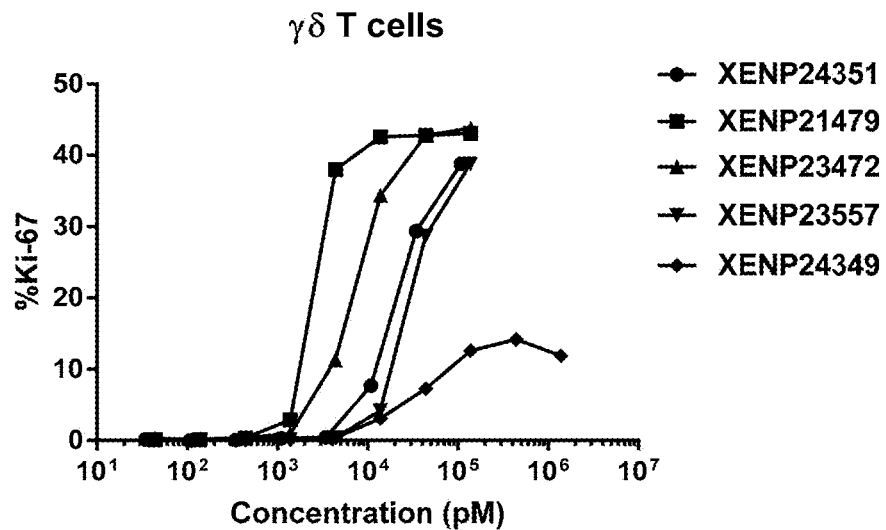
Figure 54D:
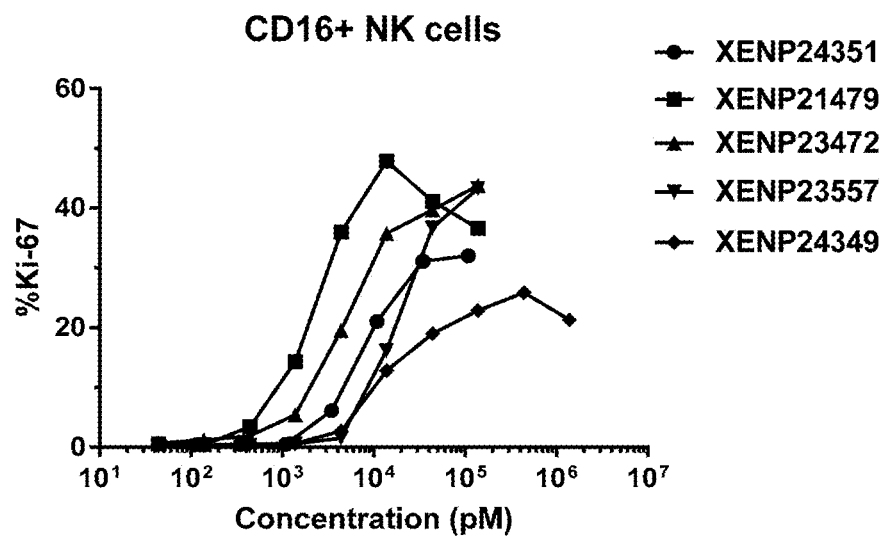

FIGS. 49A-49D depict cell proliferation in human PBMCs incubated for three days with the indicated variant IL-15/Rα-Fc fusion proteins. FIGS. 54A-C show the percentage of proliferating CD8+ (CD45RA−) T cells (FIG. 49A), CD4+(CD45RA−) T cells (FIG. 49B), γδ T cells (FIG. 49C), and NK cells (FIG. 49D).

Figure 50A:
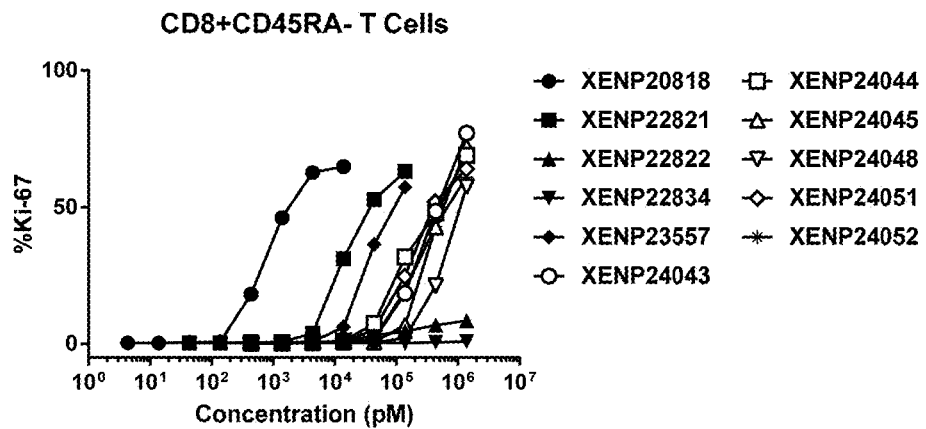
Figure 50B:
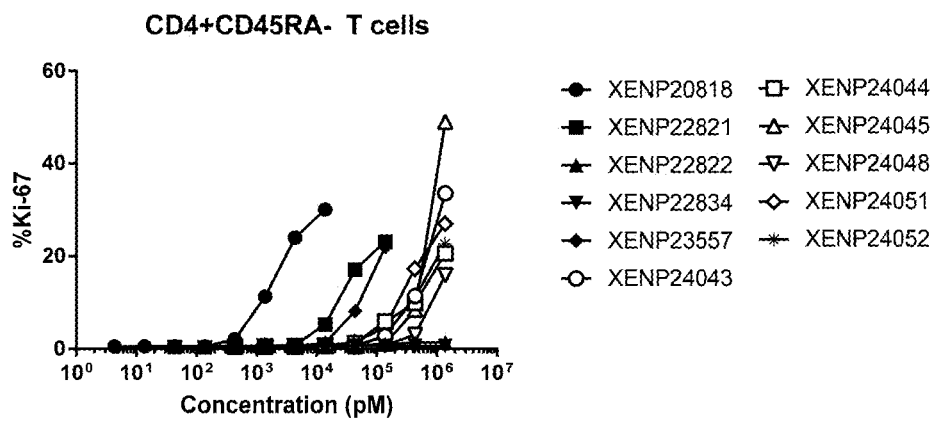
Figure 50C:
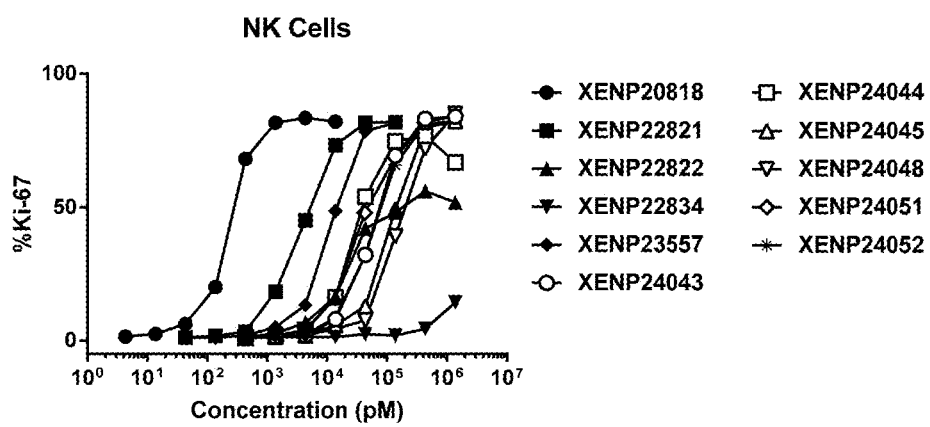
Figure 51A:
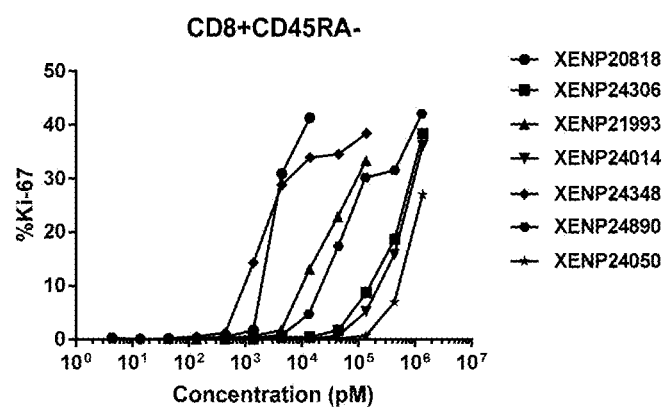
Figure 51B:
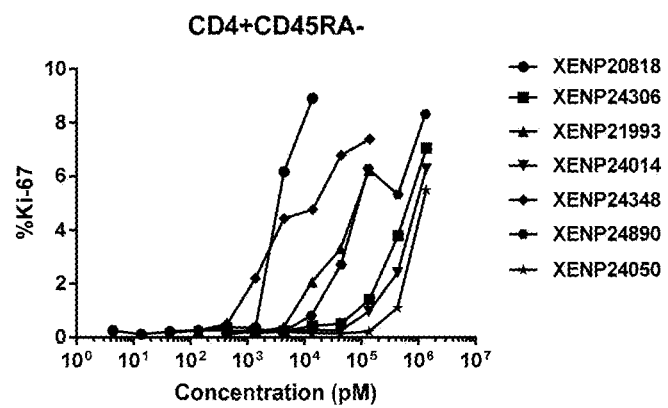
Figure 51C:
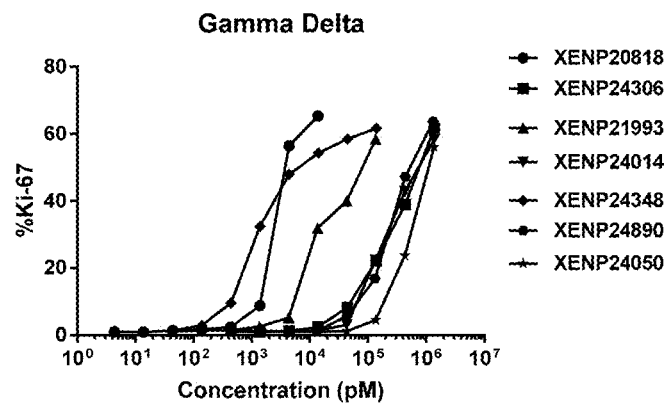
Figure 51D:
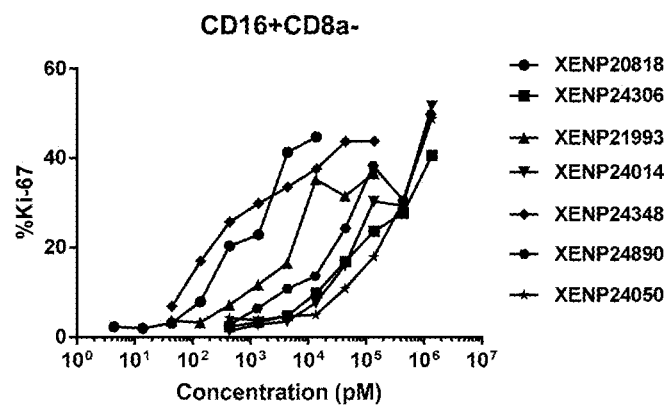
Figure 51E:
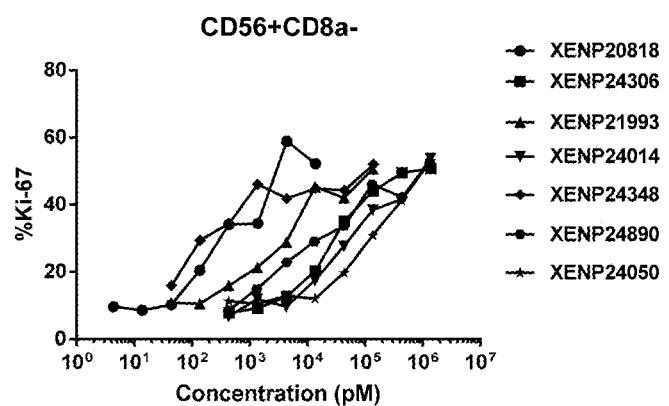
Figure 52A:
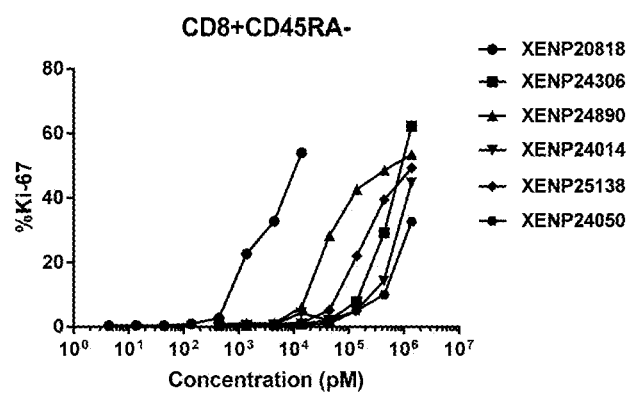
Figure 52B:
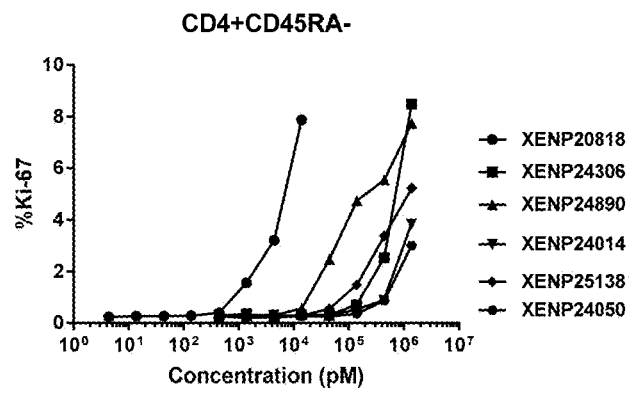
Figure 52C:
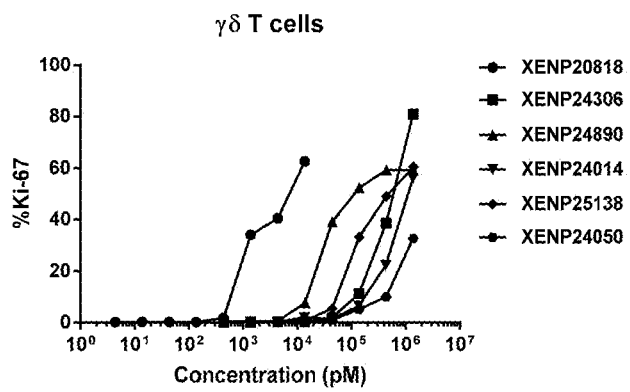
Figure 52D:
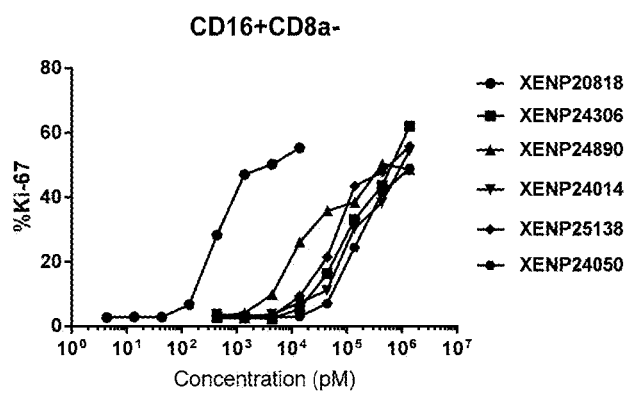
Figure 52E:
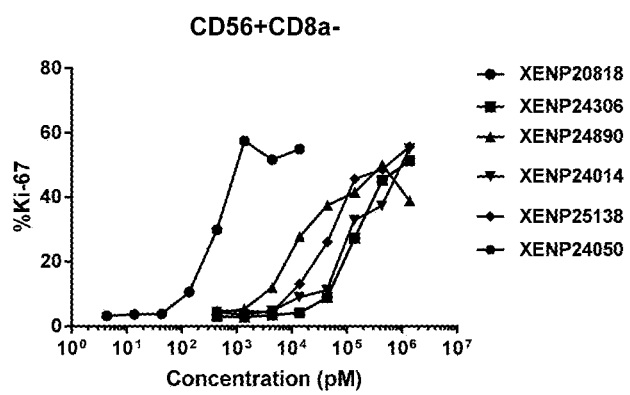
Figure 53A:
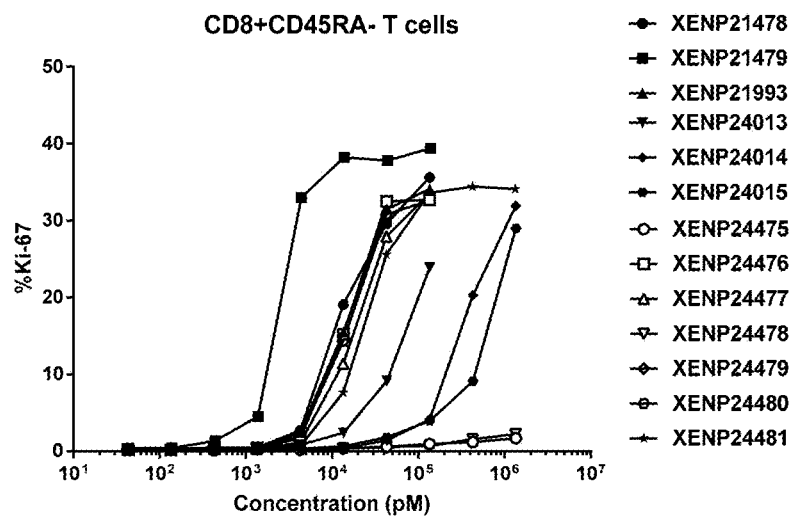
Figure 53B:
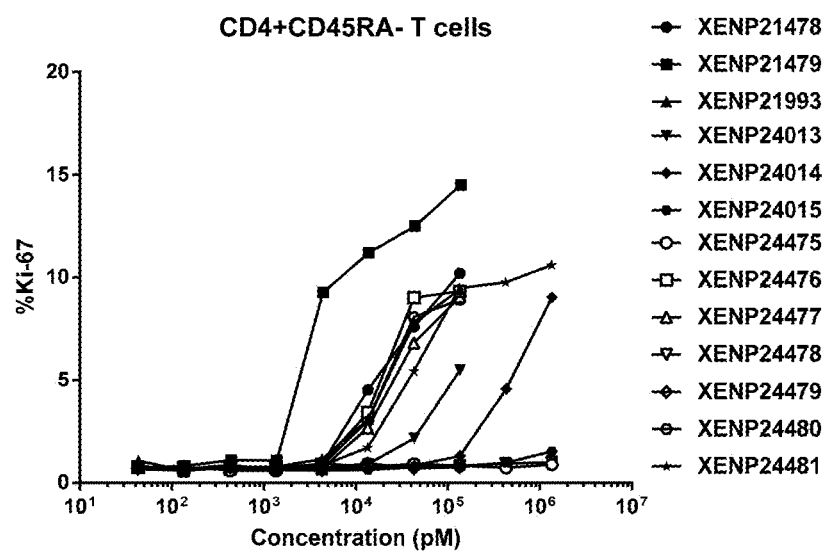
Figure 53C:
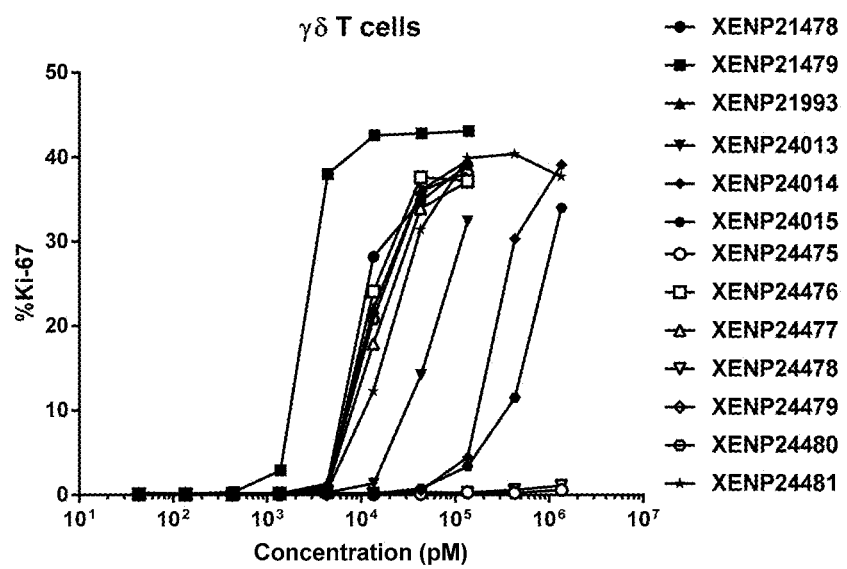
Figure 53D:
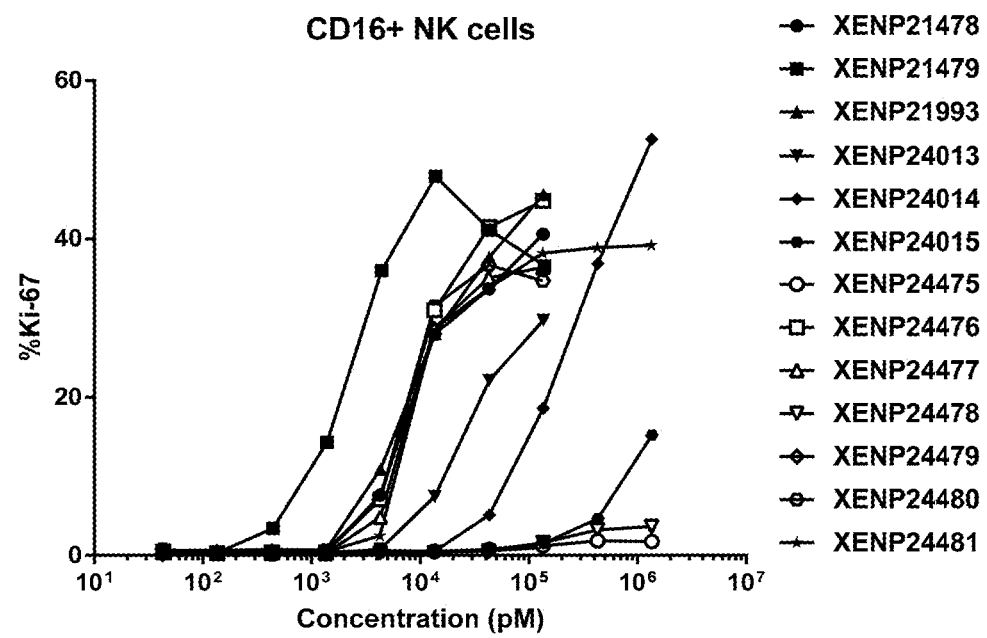

FIGS. 50A-50C depicts the percentage of Ki67 expression on (FIG. 50A) CD8+ T cells, (FIG. 50B) CD4+ T cells, and (FIG. 50C) NK cells following treatment with additional IL-15/Rα variants.

FIGS. 51A-51E depict the percentage of Ki67 expression on (FIG. 51A) CD8+(CD45RA−) T cells, (FIG. 51B) CD4+ (CD45RA−) T cells, (FIG. 51C) γδ T cells, (FIG. 51D) NK (CD16+CD8α−) cells, and (FIG. 51E) NK (CD56+CD8α−) cells following treatment with IL-15/Rα variants.

FIGS. 52A-52E depict the percentage of Ki67 expression on (FIG. 52A) CD8+(CD45RA−) T cells, (FIG. 52B) CD4+ (CD45RA−) T cells, (FIG. 52C) γδ T cells, (FIG. 52D) NK (CD16+CD8α−) cells, and (FIG. 52E) NK (CD56+CD8α−) cells following treatment with IL-15/Rα variants.

FIGS. 53A-53D depicts the percentage of Ki67 expression on (FIG. 53A) CD8+ T cells, (FIG. 53B) CD4+ T cells, (FIG. 53C) γδ T cells and (FIG. 53D) NK (CD16+) cells following treatment with additional IL-15/Rα variants.

FIG. 54A-54D depicts the percentage of Ki67 expression on (FIG. 54A) CD8+ T cells, (FIG. 54B) CD4+ T cells, (FIG. 54C) γδ T cells and (FIG. 54D) NK (CD16+) cells following treatment with additional IL-15/Rα variants.

Figure 55:
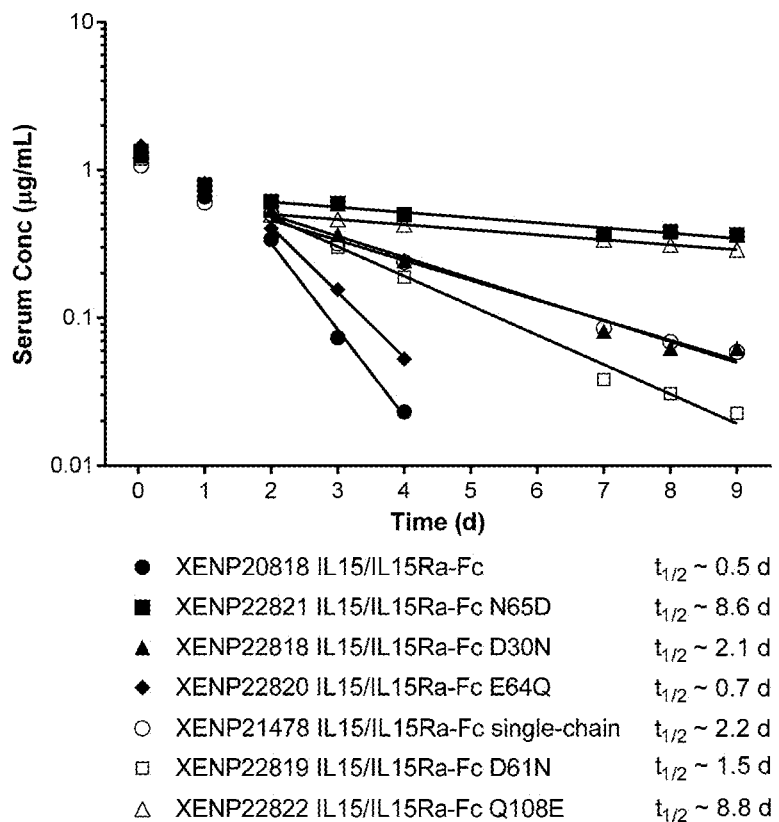

FIG. 55 depicts IV-TV Dose PK of various IL-15/Rα Fc fusion proteins or controls in C57BL/6 mice at 0.1 mg/kg single dose.

Figure 56:
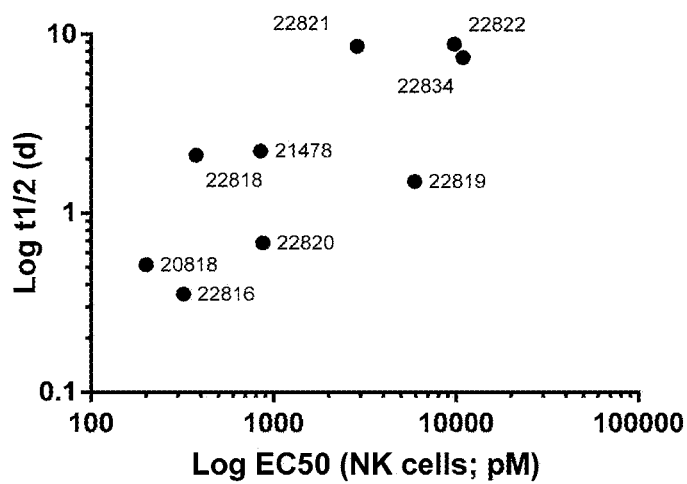

FIG. 56 depicts the correlation of half-life vs NK cell potency following treatment with IL-15/Rα-Fc fusion proteins engineered for lower potency.

FIGS. 57A-57K depict several formats for the X-targeted IL-15/Rα-Fc fusion proteins of the present invention. X may be, but is not limited to, CD8, NKG2A, and NKG2D. The "scIL-15/RαxscFv" format (FIG. 57A) comprises IL-15Rα (sushi) fused to IL-15 by a variable length linker (termed "scIL-15/Rα") which is then fused to the N-terminus of a heterodimeric Fc-region, with an scFv fused to the other side of the heterodimeric Fc. The "scFv×ncIL-15/Rα" format (FIG. 57B) comprises an scFv fused to the N-terminus of a heterodimeric Fc-region, with IL-15Rα(sushi) fused to the other side of the heterodimeric Fc, while IL-15 is transfected separately so that a non-covalent IL-15/Rα complex is formed. The "scFv×dsIL-15/Rα" format (FIG. 57C) is the same as the "scFv x ncIL-15/Rα" format, but wherein IL-15Rα(sushi) and IL-15 are covalently linked as a result of engineered cysteines. The "scIL-15/RαxFab" format (FIG. 57D) comprises IL-15Rα(sushi) fused to IL-15 by a variable length linker (termed "scIL-15/Rα") which is then fused to the N-terminus of a heterodimeric Fc-region, with a variable heavy chain (VH) fused to the other side of the heterodimeric Fc, while a corresponding light chain is transfected separately so as to form a Fab with the VH. The "ncIL-15/RαxFab" format (FIG. 57E) comprises a VH fused to the N-terminus of a heterodimeric Fc-region, with IL-15Rα(sushi) fused to the other side of the heterodimeric Fc, while a corresponding light chain is transfected separately so as to form a Fab with the VH, and while IL-15 is transfected separately so that a non-covalent IL-15/Rα complex is formed. The "dsIL-15/RαxFab" format (FIG. 57F) is the same as the "ncIL-15/RαxFab" format, but wherein IL-15Rα(sushi) and IL-15 are covalently linked as a result of engineered cysteines. The "mAb-scIL-15/Rα" format (FIG. 57G) comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form a Fabs with the VHs. The "mAb-ncIL-15/Rα" format (FIG. 57H) comprises VH fused to the N-terminus of a first and a second heterodimeric Fc, with IL-15Rα(sushi) fused to the C-terminus of one of the heterodimeric Fc-region, while corresponding light chains are transfected separately so as to form a Fabs with the VHs, and while and while IL-15 is transfected separately so that a non-covalent IL-15/Rα complex is formed. The "mAb-dsIL-15/Rα" format (FIG. 57I) is the same as the "mAb-ncIL-15/Rα" format, but wherein IL-15Rα(sushi) and IL-15 are covalently linked as a result of engineered cysteines. The "central-IL-15/Rα" format (FIG. 57J) comprises a VH recombinantly fused to the N-terminus of IL-15 which is then further fused to one side of a heterodimeric Fc and a VH recombinantly fused to the N-terminus of IL-15Rα(sushi) which is then further fused to the other side of the heterodimeric Fc, while corresponding light chains are transfected separately so as to form a Fabs with the VHs. The "central-scIL-15/Rα" format (FIG. 57K) comprises a VH fused to the N-terminus of IL-15Rα(sushi) which is fused to IL-15 which is then further fused to one side of a heterodimeric Fc and a VH fused to the other side of the heterodimeric Fc, while corresponding light chains are transfected separately so as to form a Fabs with the VHs.

FIG. 58 depicts the sequences for illustrative anti-NKG2A mAbs based on monalizumab (as disclosed in U.S. Pat. No. 8,901,283, issued Dec. 2, 2014) as chimeric mAb (XENP24542) and as humanized mAb (XENP24542). The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 59 depicts the sequences for illustrative anti-NKG2D mAbs based on MS (disclosed in U.S. Pat. No. 7,879,985, issued Feb. 1, 2011). The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIGS. 60A-60B depict the sequences for XENP24531, XENP24532, and XENP27146, illustrative NKG2A-targeted IL-15/Rα-Fc fusions of the scIL-15/RαxFab format. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

FIG. 61A-61B depicts the sequences for XENP24533, XENP24534, and XENP27145, illustrative NKG2D-targeted IL-15/Rα-Fc fusions of the scIL-15/RαxFab format. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

Figure 62A:
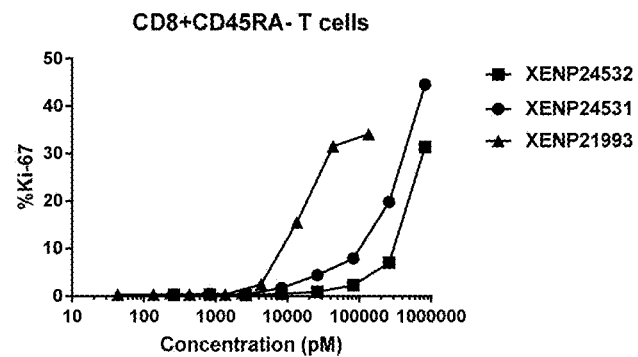
Figure 62B:
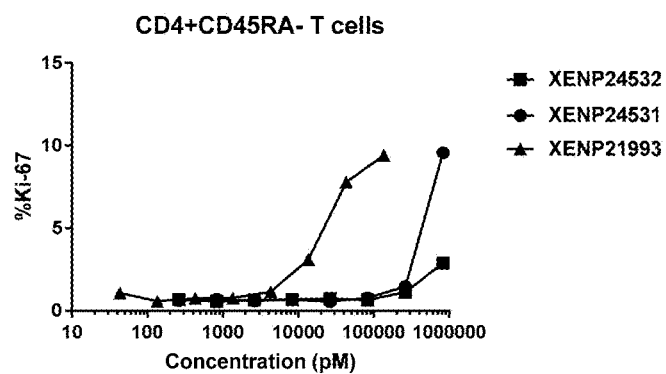
Figure 62C:
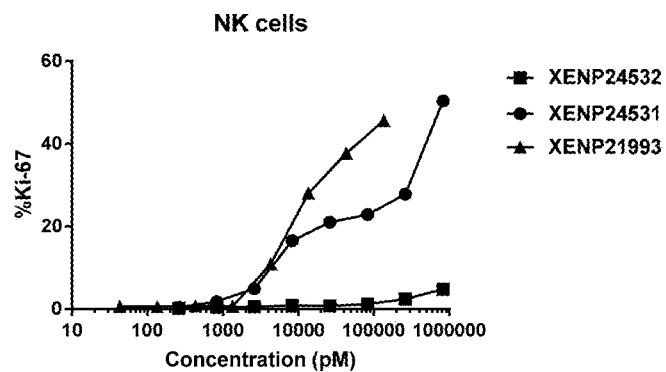

FIGS. 62A-62C depict the percentage of Ki67 expression on (FIG. 62A) CD4+ T cells, (FIG. 62B) CD8+ T cells and (FIG. 62C) NK cells following treatment with NKG2A-targeted reduced potency IL-15/Rα-Fc fusions (and control scIL-15/Rα-Fc).

Figure 63A:
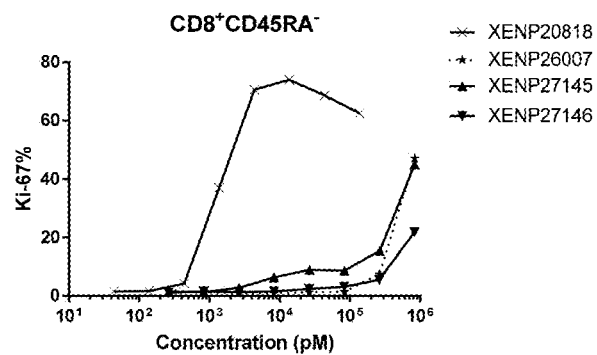
Figure 63B:
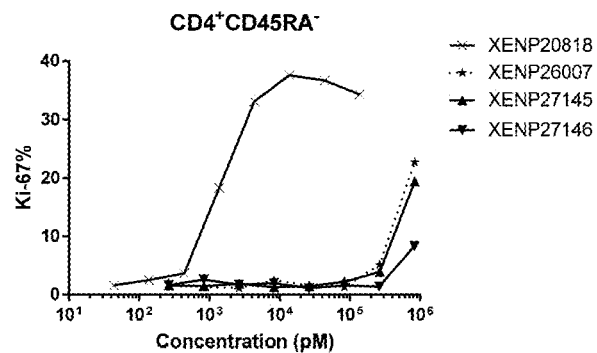
Figure 63C:
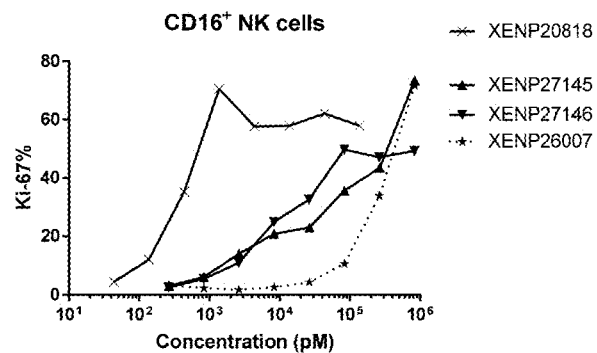
Figure 64A:
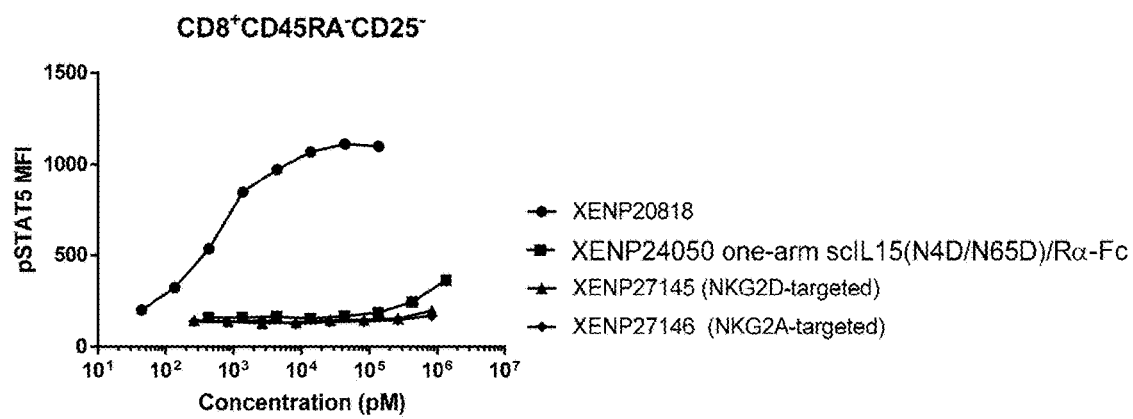
Figure 64B:
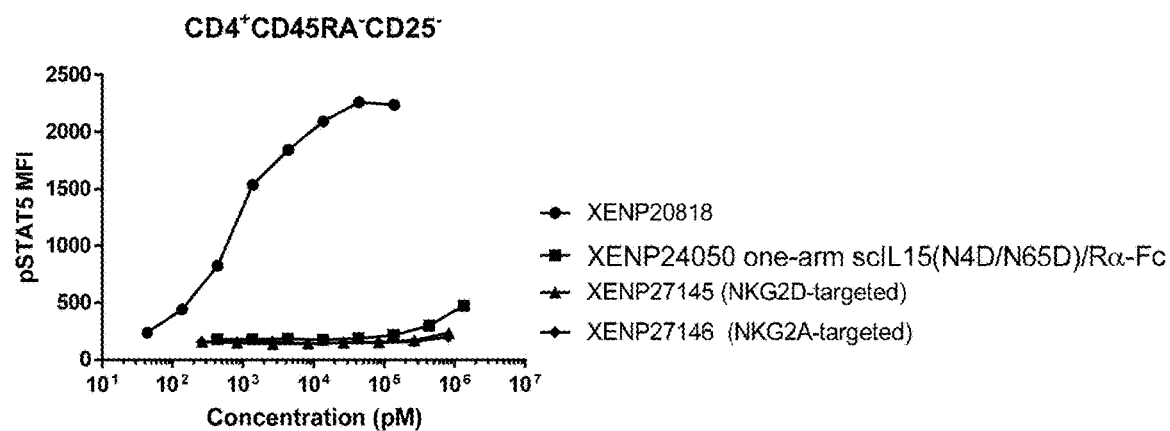
Figure 64C:
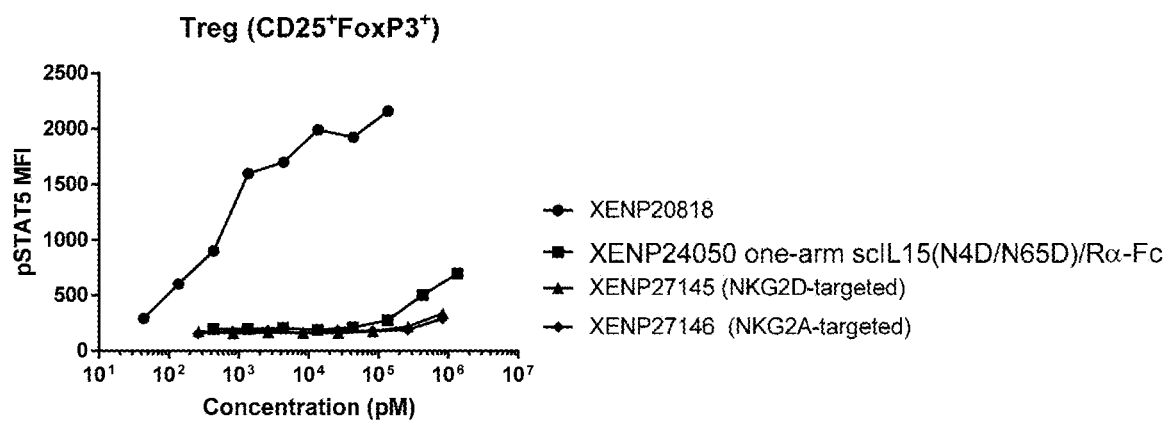
Figure 64D:
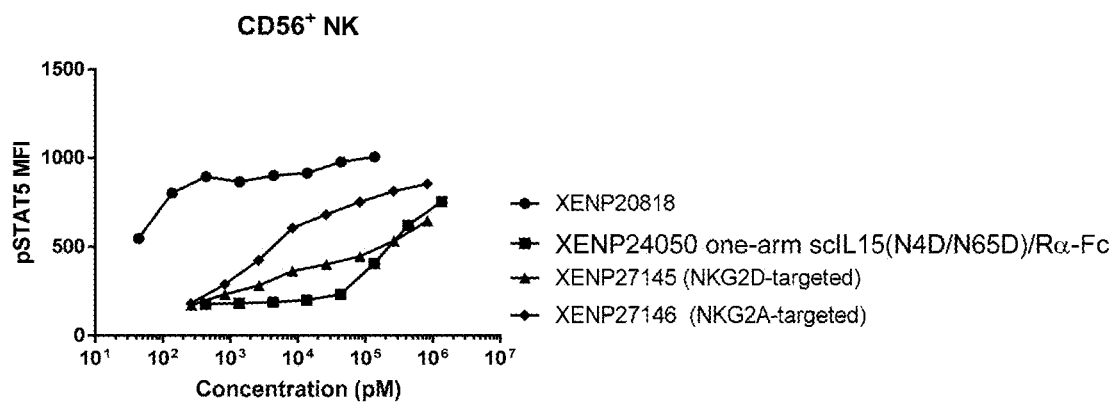

FIGS. 63A-63C depict percentage of (FIG. 63A) CD8+ CD45RA− T cells, (FIG. 63B) CD4+CD45RA− T cells, and (FIG. 63C) CD16+NK cells expressing Ki-67, a protein strictly associated with cell proliferation, in human PBMCs treated with the indicated test articles.

FIGS. 64A-64D depict STAT5 phosphorylation on (FIG. 64A) CD8+CD45RA− CD25− T cells, (FIG. 64B) CD4+CD45RA−CD25− T cells, (FIG. 64C) Treg (CD25+FoxP3+), and (FIG. 64D) CD56+NK cells in human PBMCs treated with the indicated test articles.

FIGS. 65A-65B depict the sequences for illustrative CD8 binding molecules based on humanized mAb (as previously described in U.S. Pat. No. 7,657,380, issued Feb. 2, 2010) formatted as chimeric mAb (XENP15076), humanized mAb (15251), humanized Fab (XENP23647), and humanized one-arm mAb (XENP24317). The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIGS. 66A-66B depict illustrative CD8-targeted IL-15/Rα-Fc fusions in the scIL-15/RαxFab format. The CDRs are in bold. As noted herein and is true for every sequence herein containing CDRs, the exact identification of the CDR locations may be slightly different depending on the numbering used as is shown in Table X, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

Figure 67A:
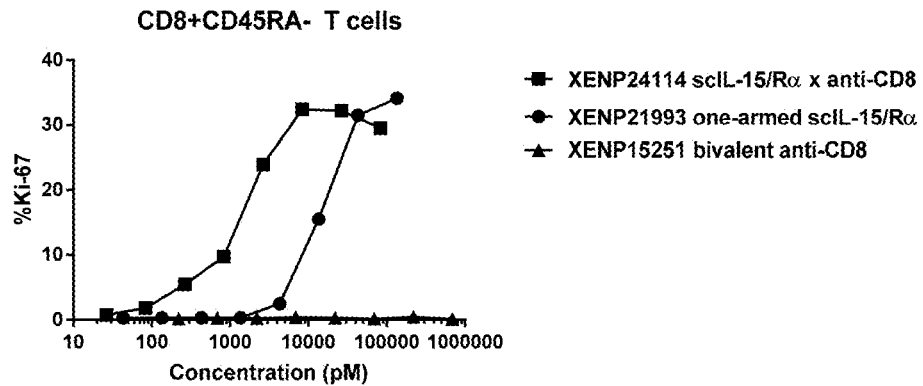
Figure 67B:
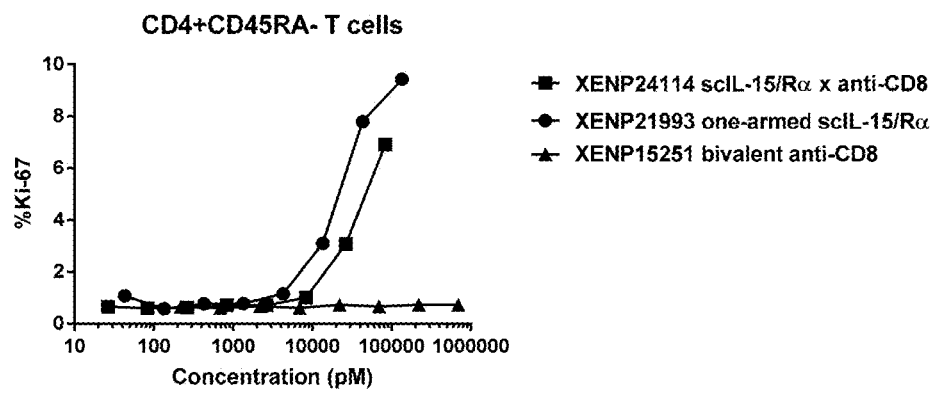
Figure 67C:
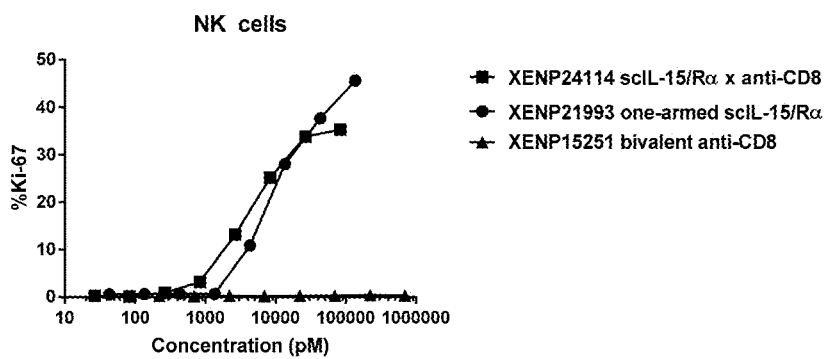

FIGS. 67A-67C depict the percentage of Ki67 expression on (FIG. 67A) CD8+ T cells, (FIG. 67B) CD4+ T cells and (FIG. 67C) NK cells following treatment with an CD9-targeted IL-15/Rα-Fc fusion (and controls anti-CD8 mAb and scIL-15/Rα-Fc).

Figure 68A:
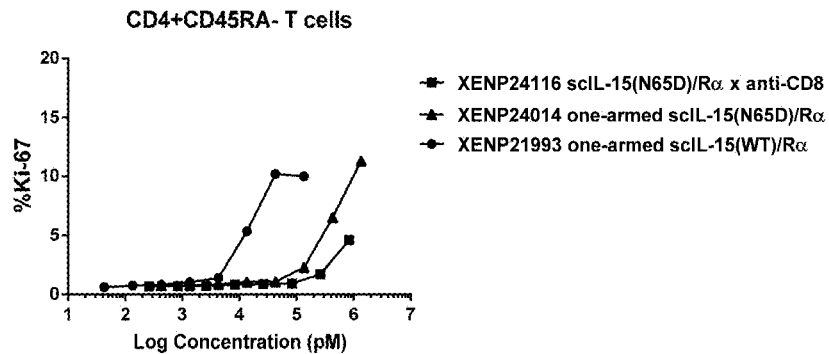
Figure 68B:
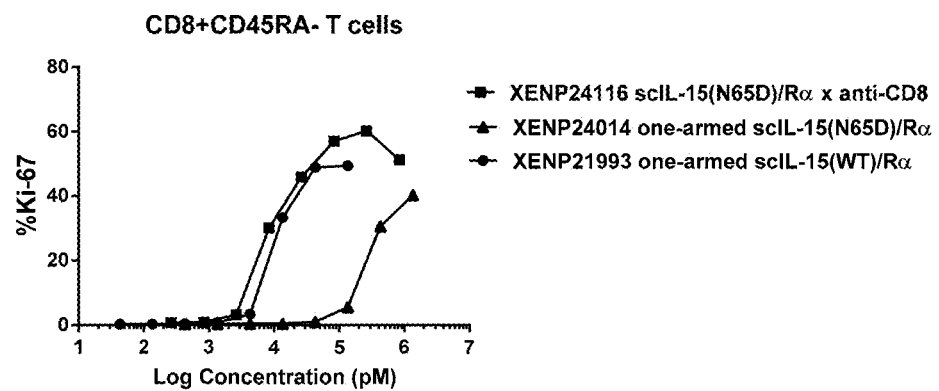
Figure 68C:
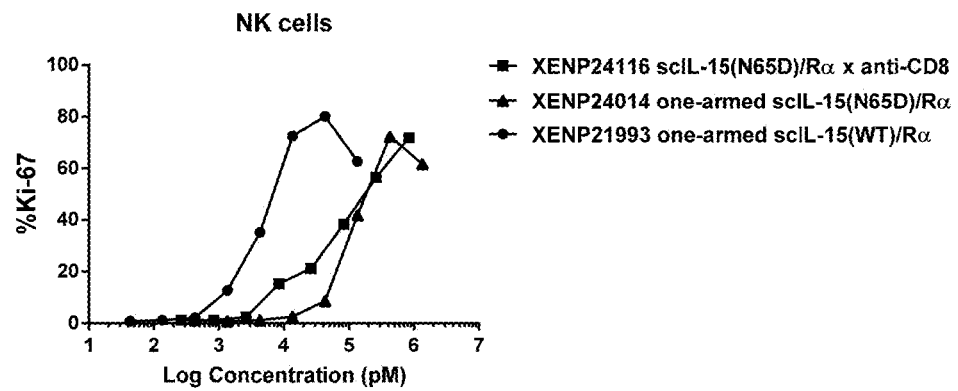

FIGS. 68A-68C depicts the percentage of Ki67 expression on (FIG. 68A) CD8+ T cells, (FIG. 68B) CD4+ T cells and (FIG. 68C) NK cells following treatment with a CD8-targeted reduced potency IL-15/Rα-Fc fusion.

Figure 69A:
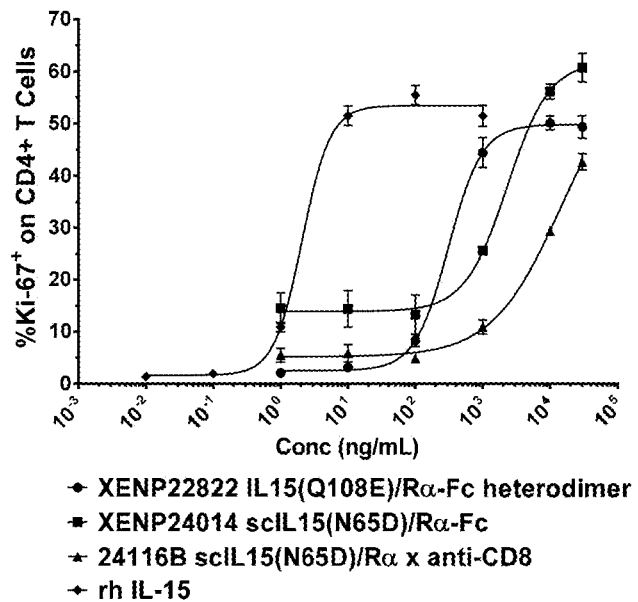
Figure 69B:
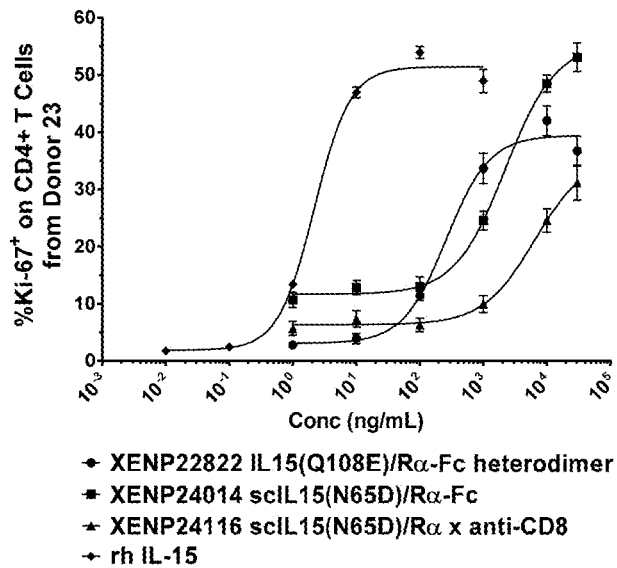

FIGS. 69A-69B depict the percentage of Ki67 expression on rapamycin enriched CD4+ T cells from (FIG. 69A) Donor 21 and (FIG. 69B) Donor 23 following treatment with CD8-targeted IL-15(N65D)/Rα-Fc fusion as well as controls.

Figure 70A:
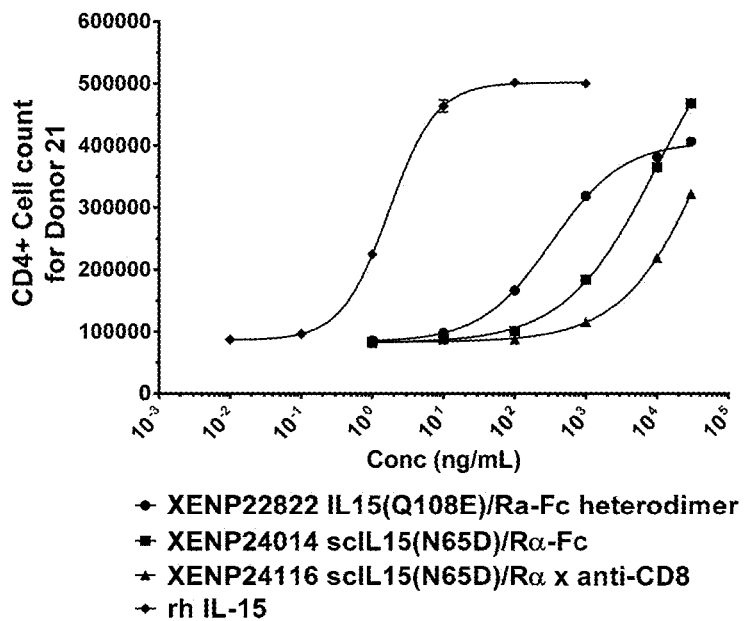
Figure 70B:
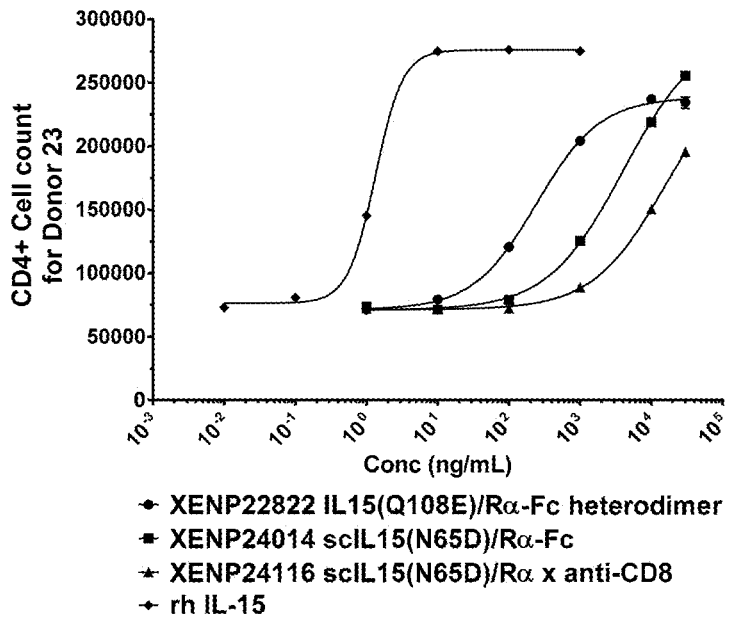

FIG. 70A-70B depicts CD4+ cell count for Tregs enriched from (FIG. 70A) Donor 21 and FIG. 70A) Donor 23 following treatment with CD8-targeted IL-15(N65D)/Rα-Fc fusion as well as controls.

Figure 71A:
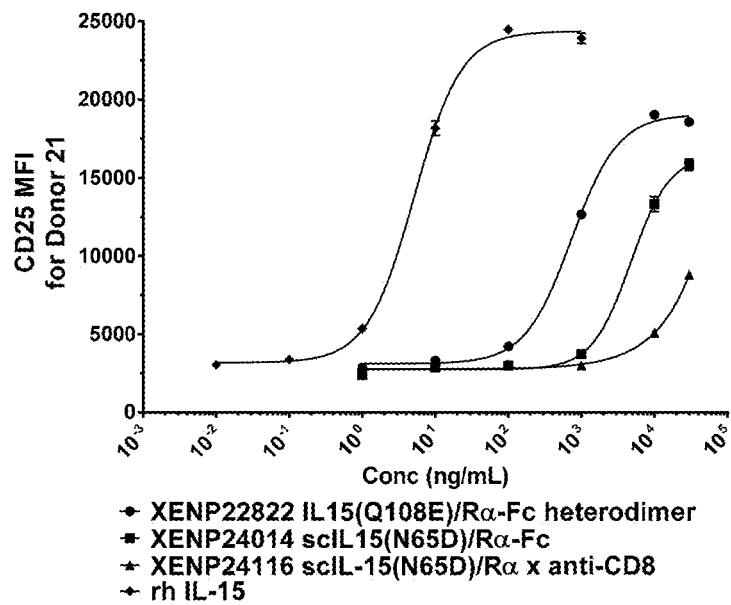
Figure 71B:
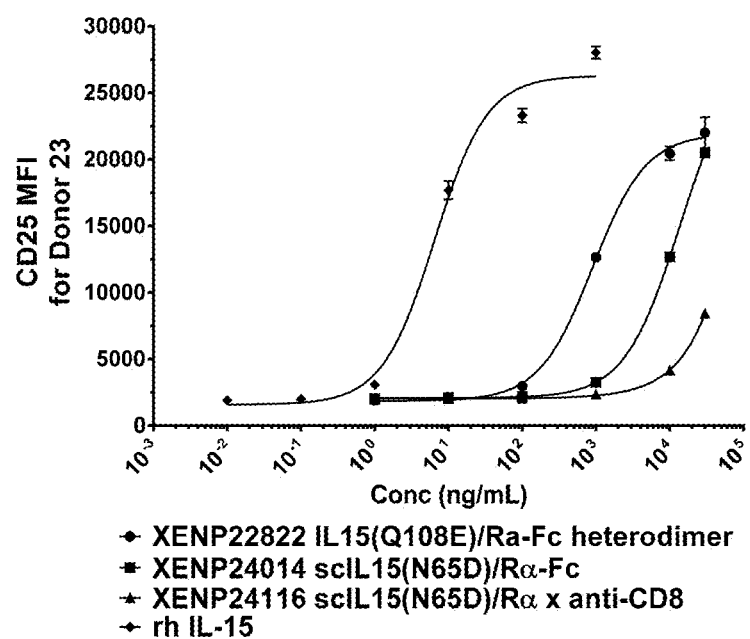

FIGS. 71A-71B depict CD25 MFI on rapamycin enriched CD4+ T cells from (FIG. 71A) Donor 21 and (FIG. 71B) Donor 23 following treatment with CD8-targeted IL-15 (N65D)/Rα-Fc fusion as well as controls.

Figure 72A:
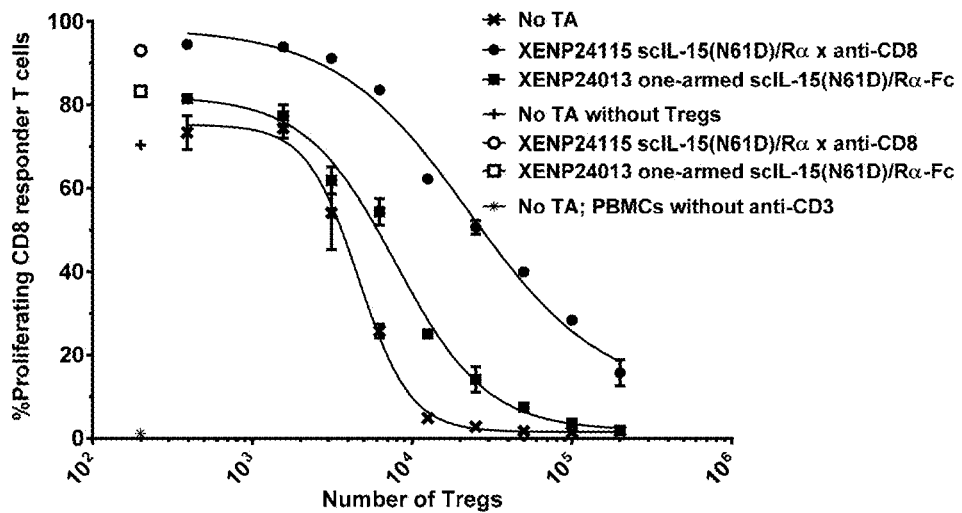
Figure 72B:
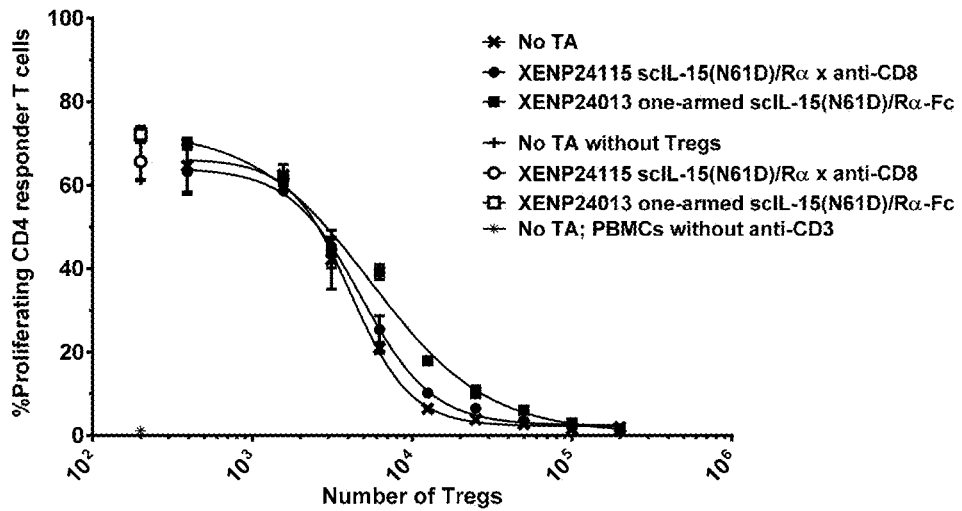
Figure 72C:
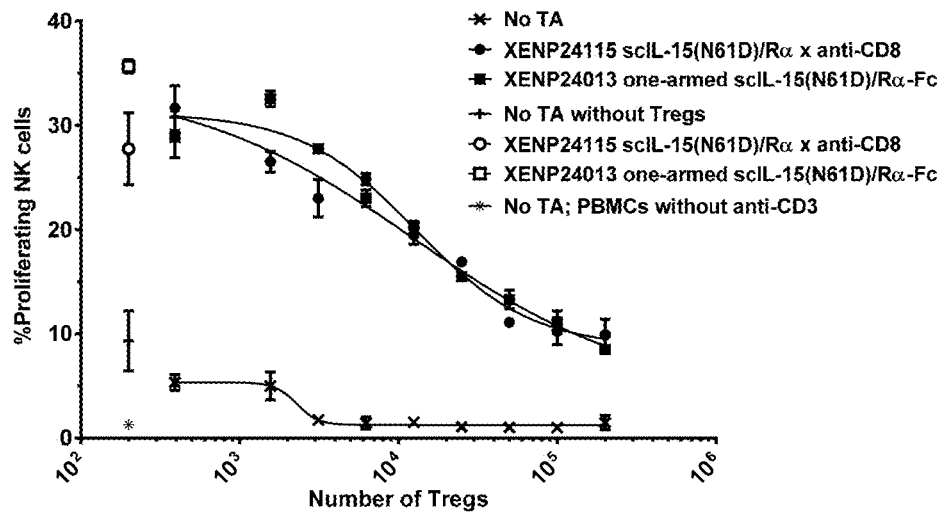

FIGS. 72A-72C depict the percentage of proliferating (FIG. 72A) CD8 responder T cell, (FIG. 72B) CD4 responder T cell, and (FIG. 72C) NK cells following treatment of PBMCs with CD8-targeted IL-15/Rα-Fc fusions in the presence of Tregs.

Figure 73:
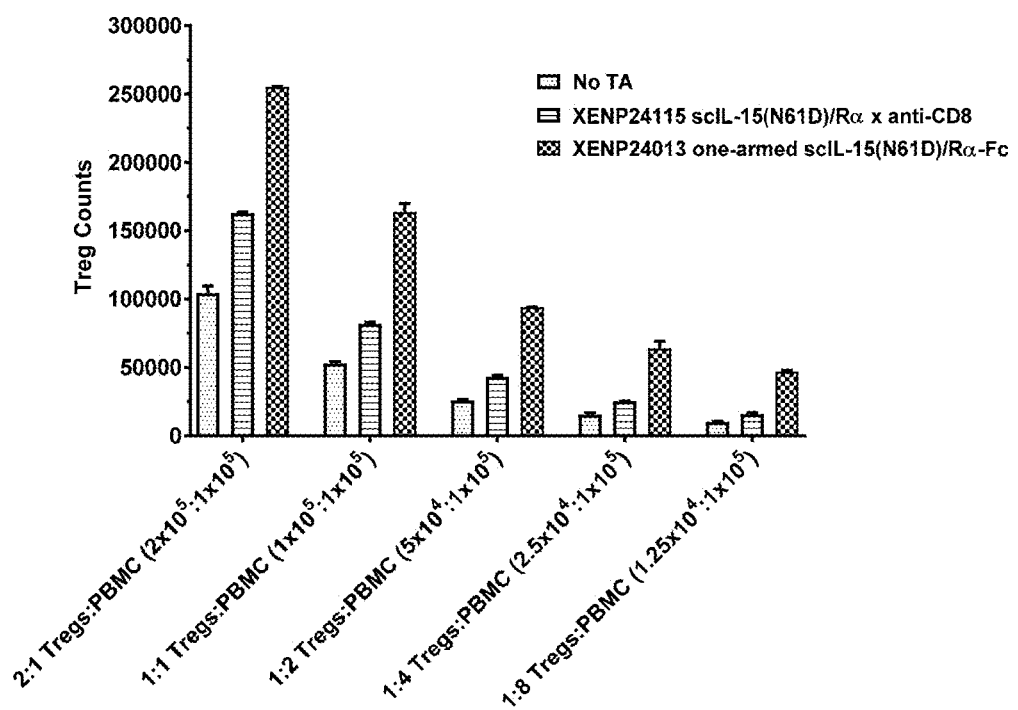

FIG. 73 depicts Treg count following treatment of PBMCs with CD8-targeted IL-15/Rα-Fc fusion in the presence of different amount of Tregs.

Figure 74A:
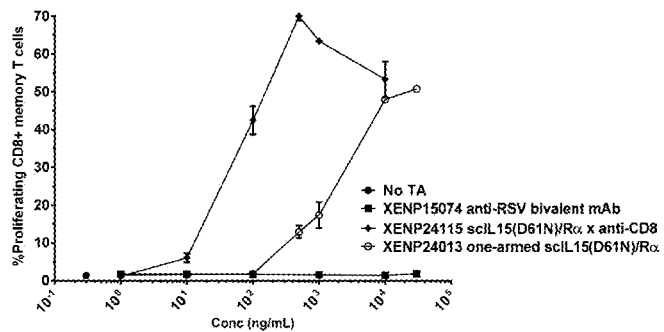
Figure 74B:
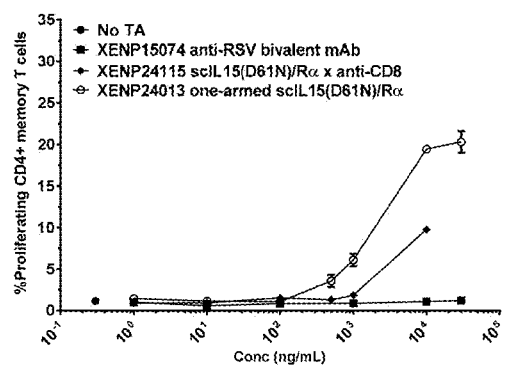
Figure 74C:
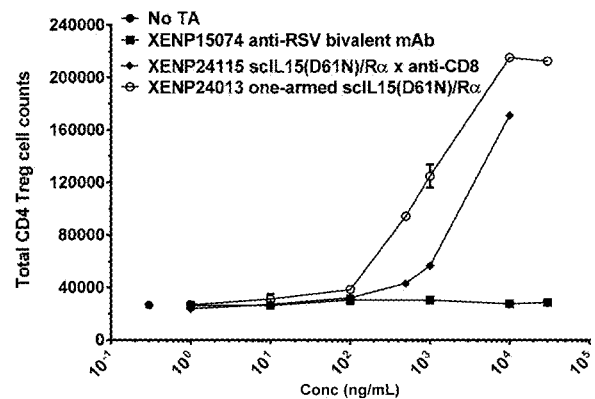

FIGS. 74A-74C depicts the percentage of proliferating (FIG. 74A) CD8 memory T cell and (FIG. 74B) CD4 responder T cell and (FIG. 74C) Treg count following treatment of PBMCs with CD8-targeted IL-15/Rα-Fc fusions and controls in the presence of Tregs (1:2 Treg: PBMC ratio).

Figure 75:
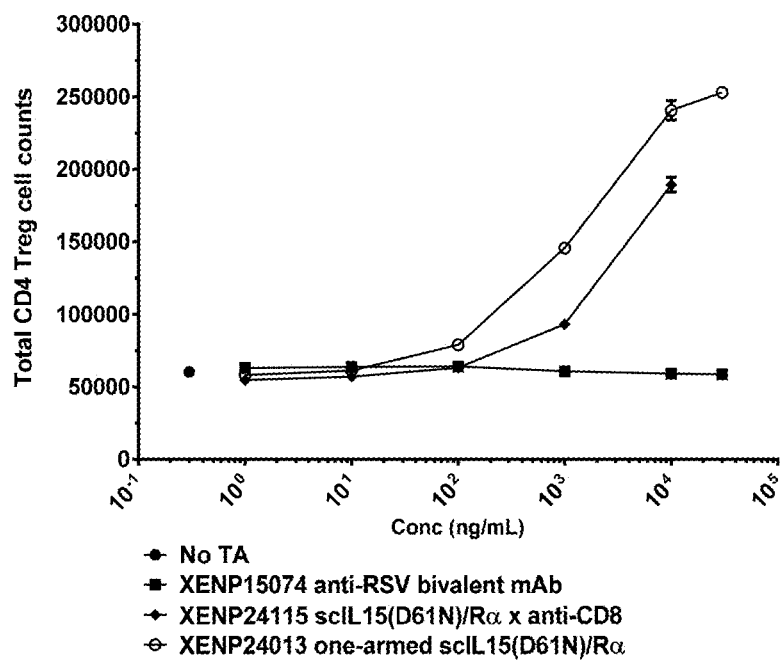
Figure 76A:
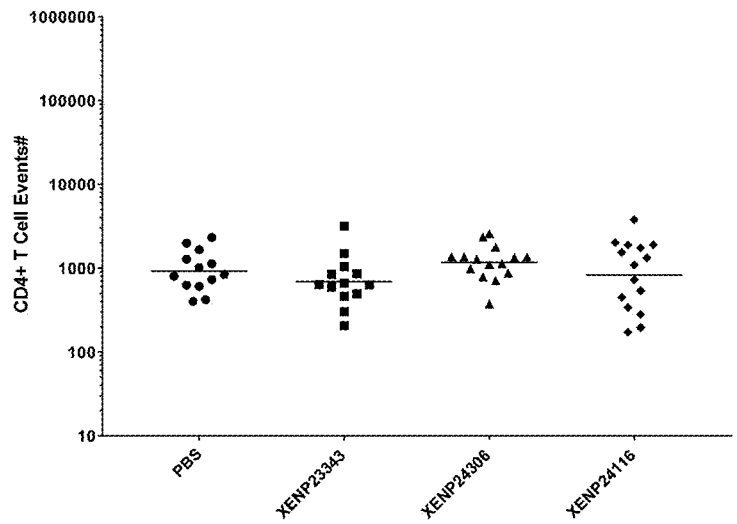
Figure 76B:
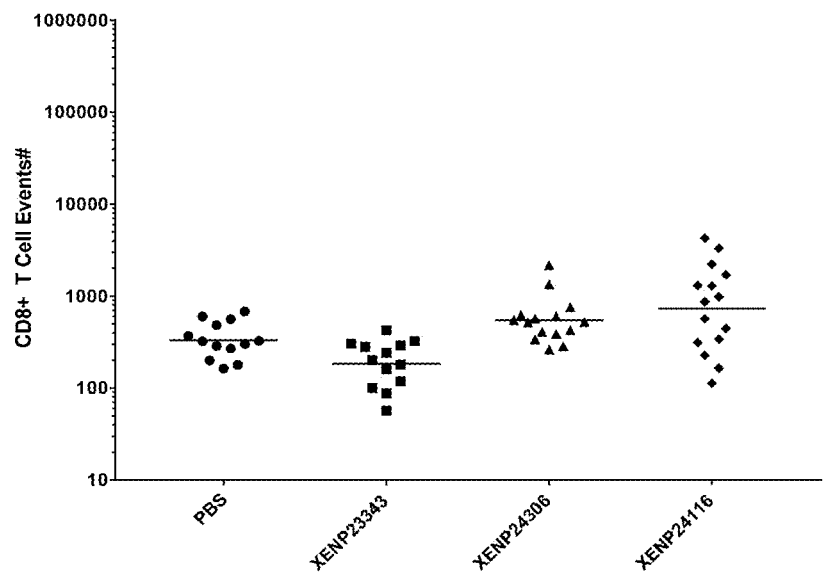
Figure 76C:
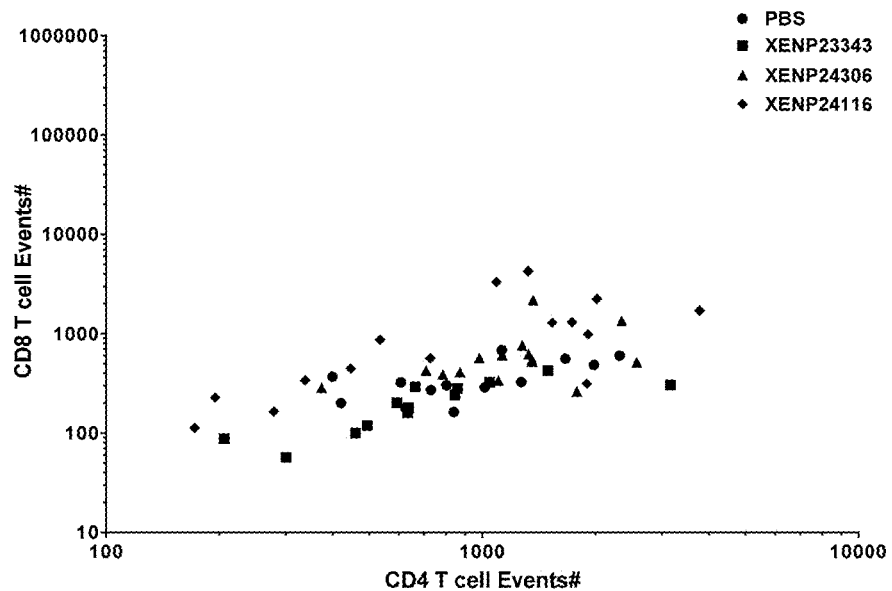
Figure 76D:
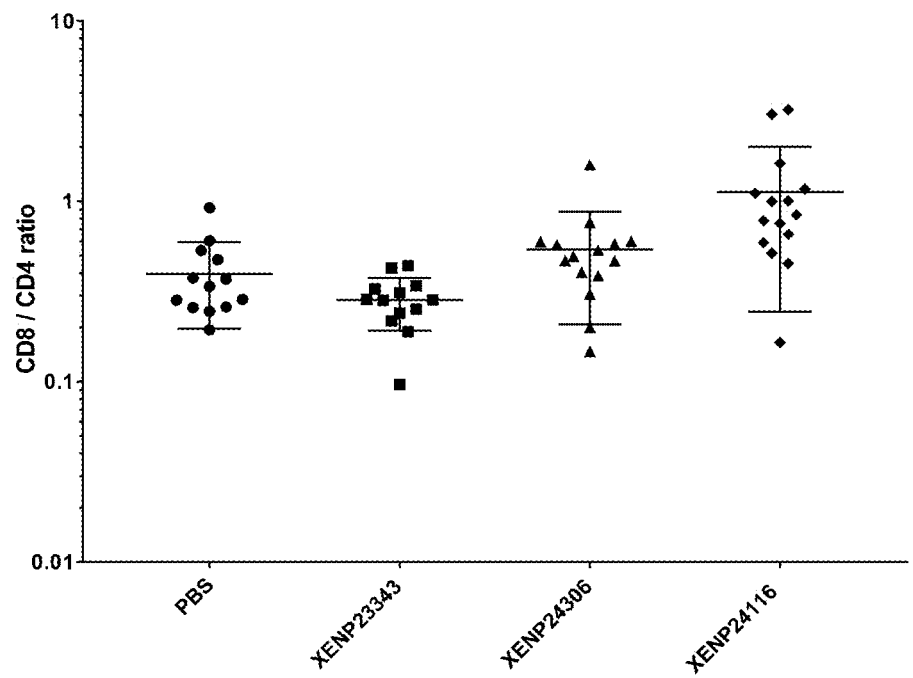
Figure 77A:
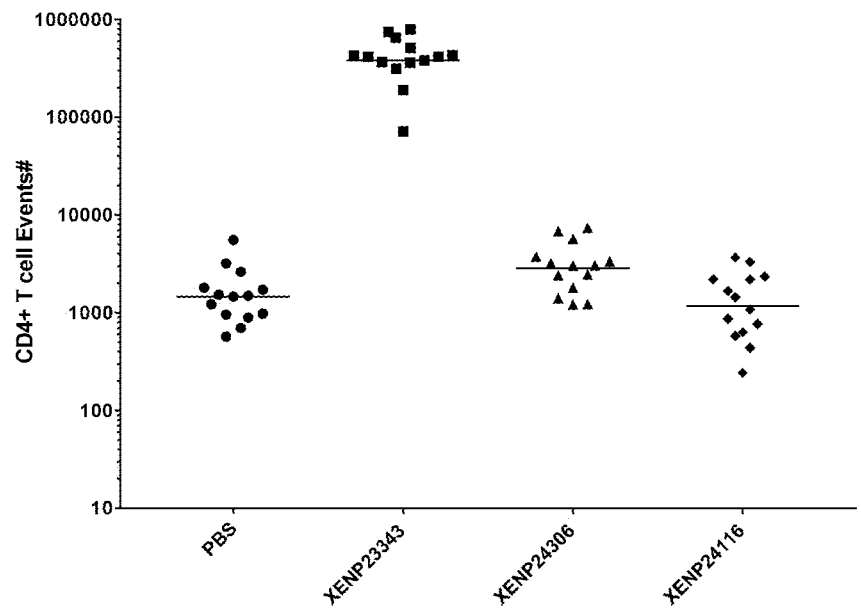
Figure 77B:
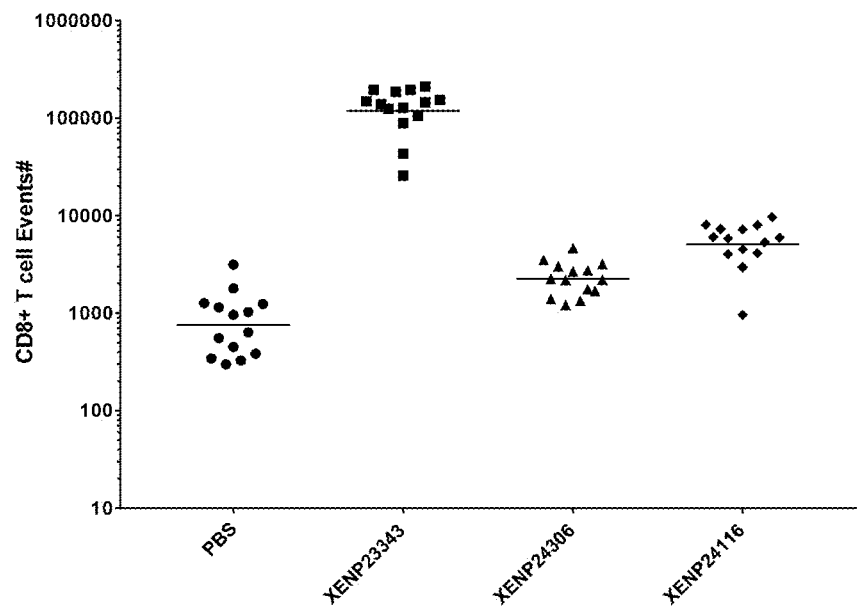
Figure 77C:
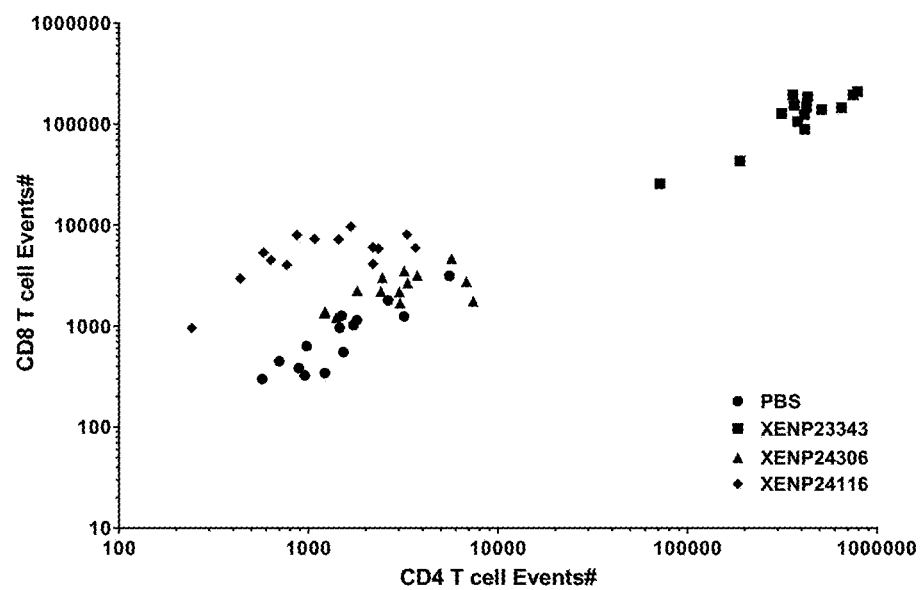
Figure 77D:
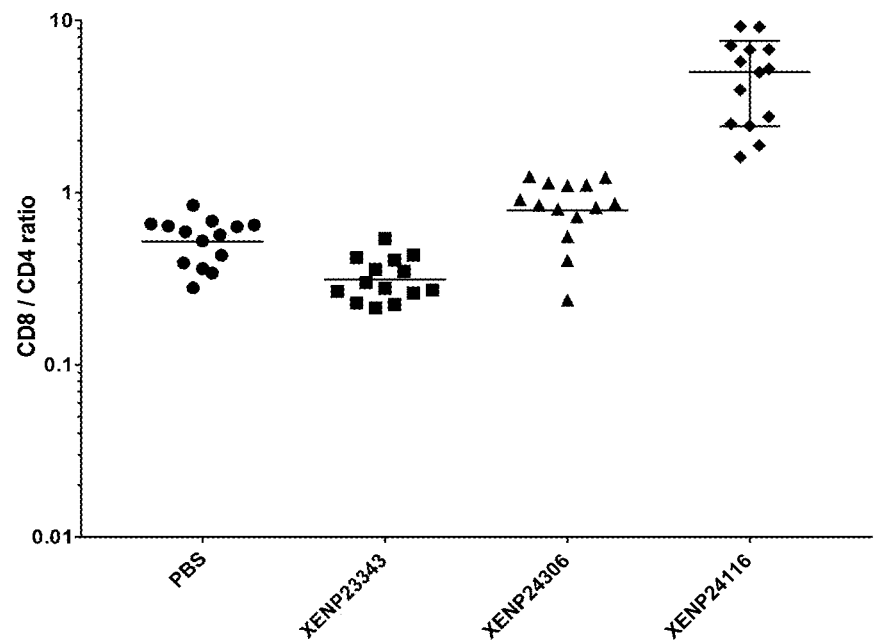
Figure 78A:
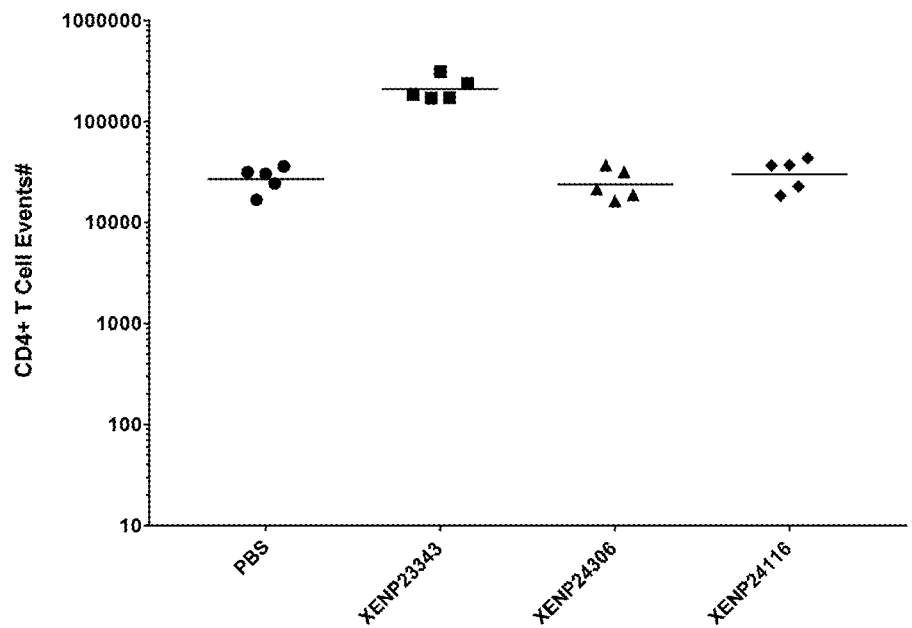
Figure 78B:
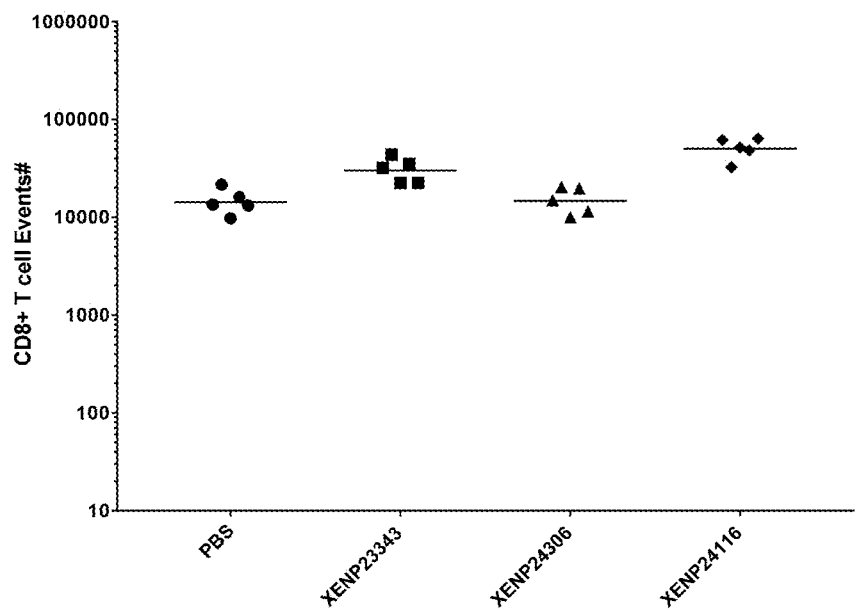
Figure 78C:
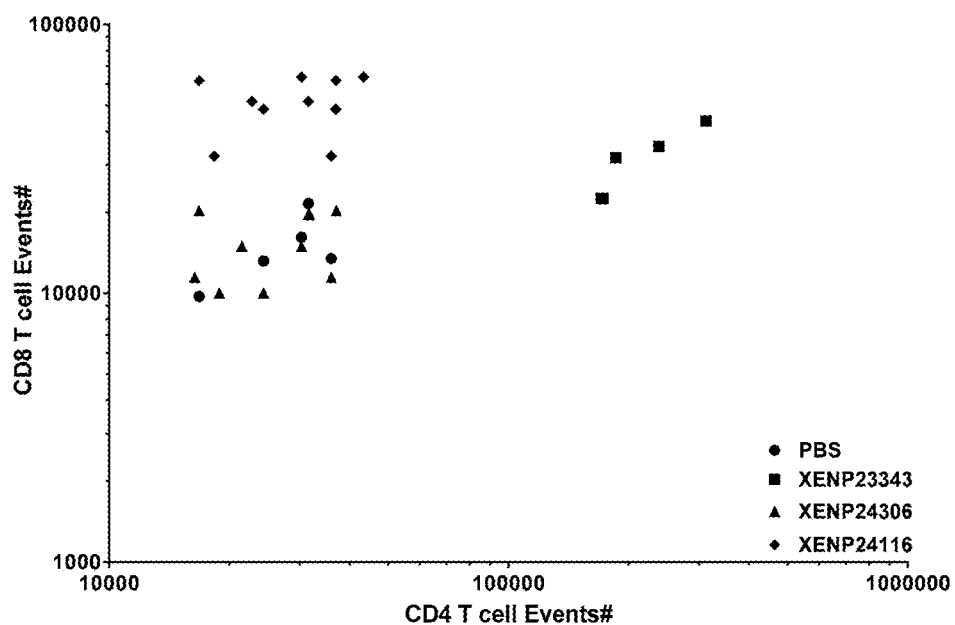
Figure 78D:
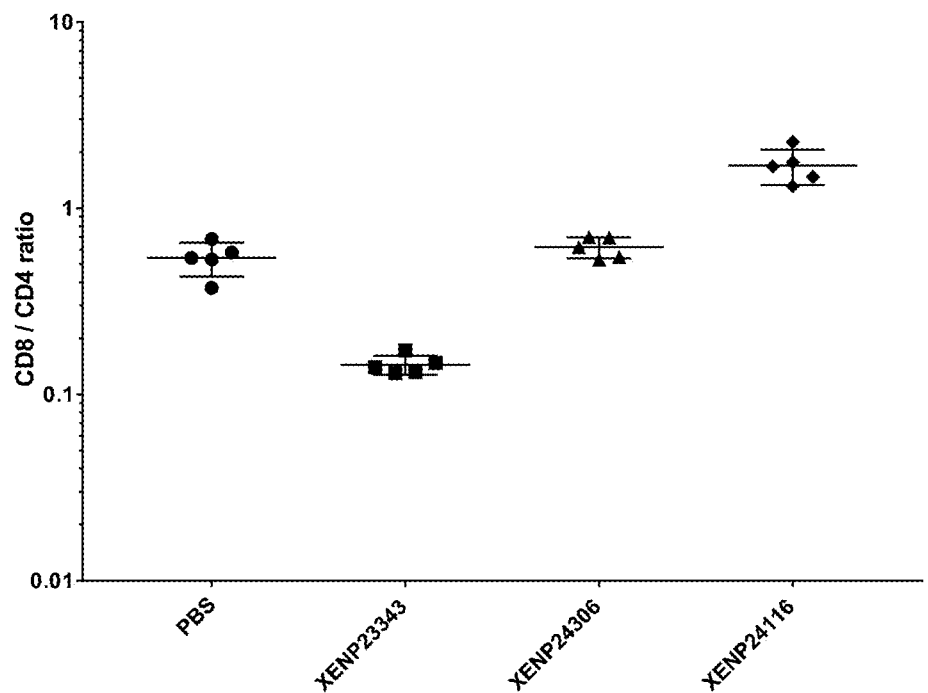

FIG. 75 depicts Treg count following treatment with CD8-targeted IL-15/Rα-Fc fusion and controls in the absence of PBMCs.

FIGS. 76A-76D depicts (FIG. 76A) CD4+ T cell events, (FIG. 76B) CD8+ T cell events, (FIG. 76C) the correlation between CD8+ T cell and CD4+ T cell events and (FIG. 76D) CD8+ T cell/CD4+ T cell ratio in whole blood of huPBMC engrafted mice on Day 4 following treatment with a CD8-targeted reduced potency IL-15/Rα-Fc fusion and IL-15/Rα-Fc fusion variants.

FIGS. 77A-77D depict (FIG. 77A) CD4+ T cell events, (FIG. 77B) CD8+ T cell events, (FIG. 77C) the correlation between CD8+ T cell and CD4+ T cell events, and (FIG. 77D) CD8+ T cell/CD4+ T cell ratio in whole blood of huPBMC engrafted mice on Day 7 following treatment with a CD8-targeted reduced potency IL-15/Rα-Fc fusion and IL-15/Rα-Fc fusion variants.

FIGS. 78A-78D depict (FIG. 78A) CD4+ T cell events, (FIG. 78B) CD8+ T cell events, (FIG. 78C) the correlation between CD8+ T cell and CD4+ T cell events and (FIG. 78D) CD8+ T cell/CD4+ T cell ratio in spleen of huPBMC engrafted mice on Day 8 following treatment with a CD8-targeted reduced potency IL-15/Rα-Fc fusion and IL-15/Rα-Fc fusion variants.

FIGS. 79A-79B depict illustrative sequences for CD8-targeted IL-15/Rα-Fc fusions in alternative formats (as depicted in FIG. 57. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

FIGS. 80A-80F depict the percentage of Ki67 expression on CD4+ T cells, CD8+ T cells, and NK cells following treatment with alternative format CD8-targeted IL-15/Rα-Fc fusions.

FIG. 81 depicts phage derived anti-CD8 antibody sequences. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

Figure 82:
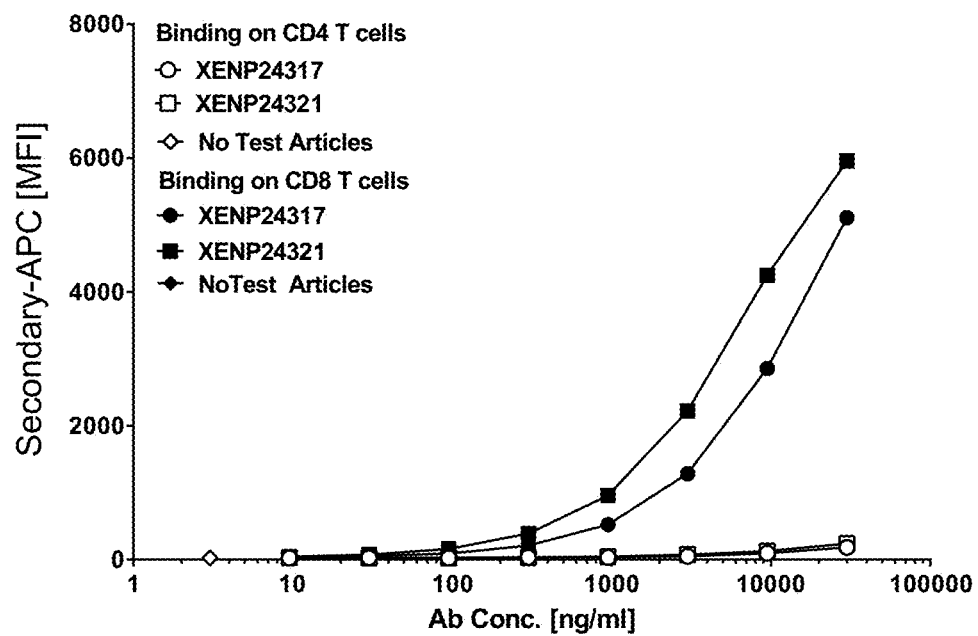

FIG. 82 depicts binding of exemplary phage hits reformatted as one-armed Fab-Fc antibodies to CD4+ and CD8+ T cells.

Figures 83A, 83B, 83C:
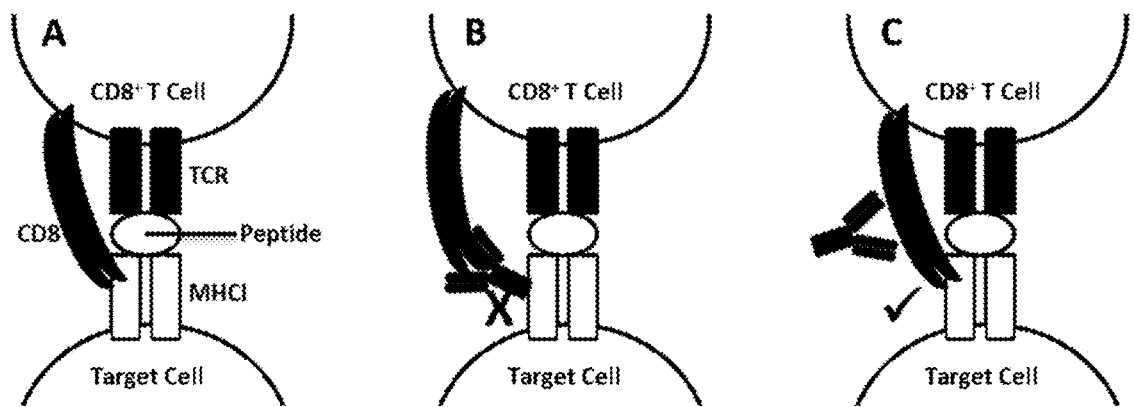

FIGS. 83A-83C diagram the binding of CD8 and TCR on CD8+ T cells to pMHCI on a target cell.

Figure 84:
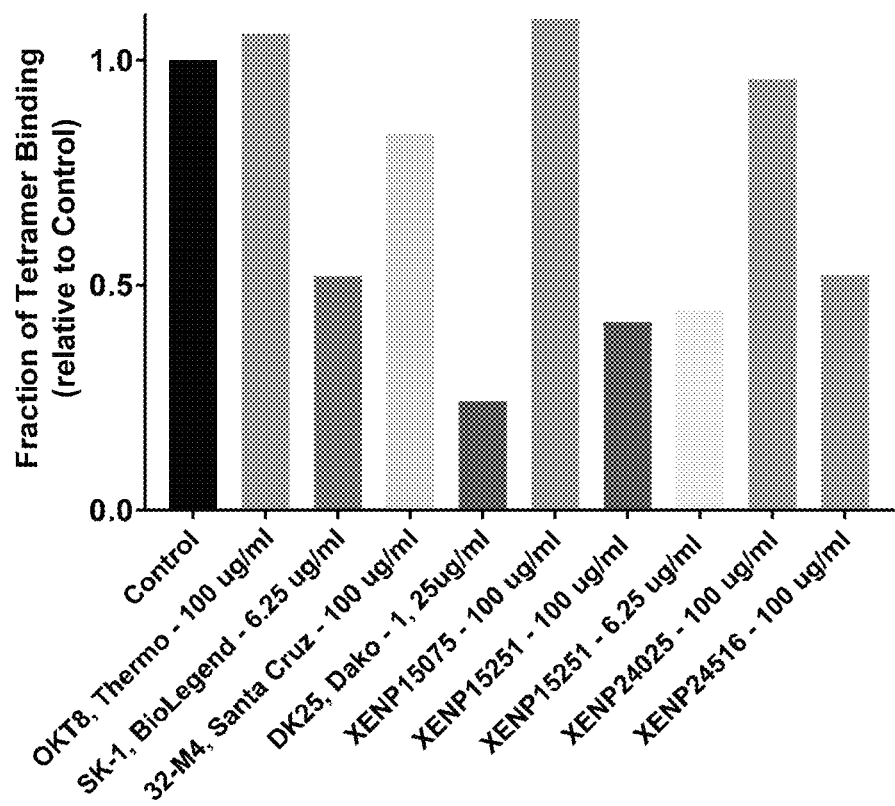

FIG. 84 depicts fraction of binding by HLA2:01 restricted MHC tetramer specific for pp65 (NLVPMVATV) peptide (SEQ ID NO: 6) to T cells specific for HLA2:01 restricted pp65 (NLVPMVATV) peptide (SEQ ID NO: 6) following pre-incubation with anti-CD8 antibodies relative to control (no pre-incubation with anti-CD8 antibody).

Figure 85:
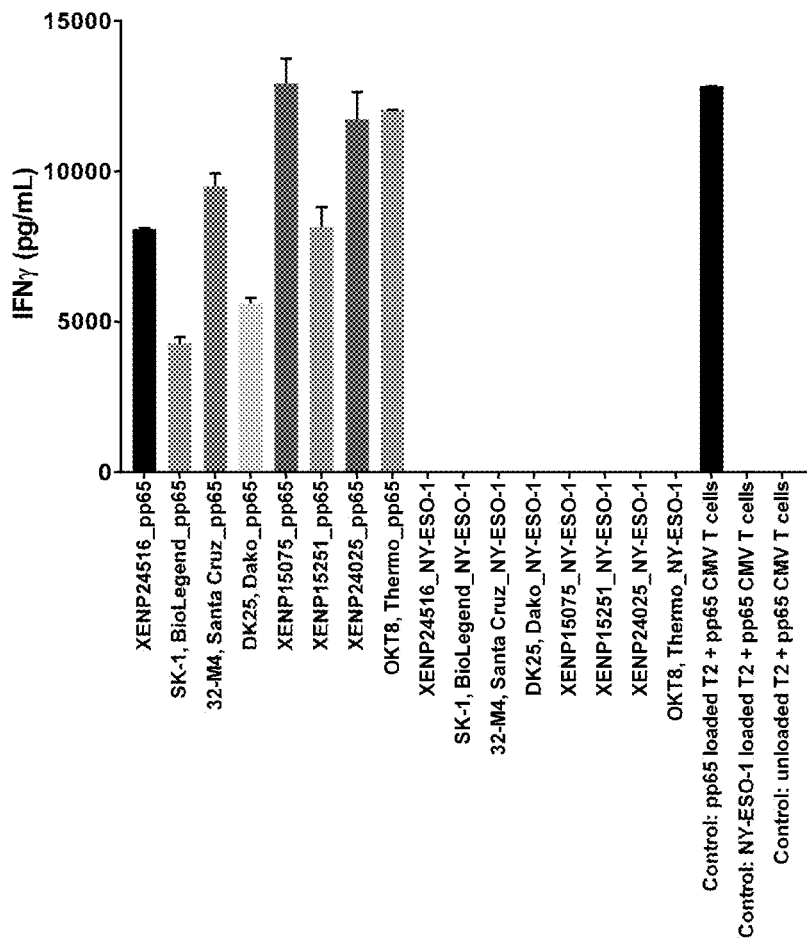

FIG. 85 depicts IFNγ release by T cells specific for HLA2:01 restricted pp65 (NLVPMVATV) peptide (SEQ ID NO: 6) (pre-incubated with various anti-CD8 antibodies) following incubation with T2 cells loaded with HLA-A2*0201 restricted CMV pp65 (NLVPMVATV) peptide (SEQ ID NO: 6) or NY-ESO-1 peptide.

Figure 86:
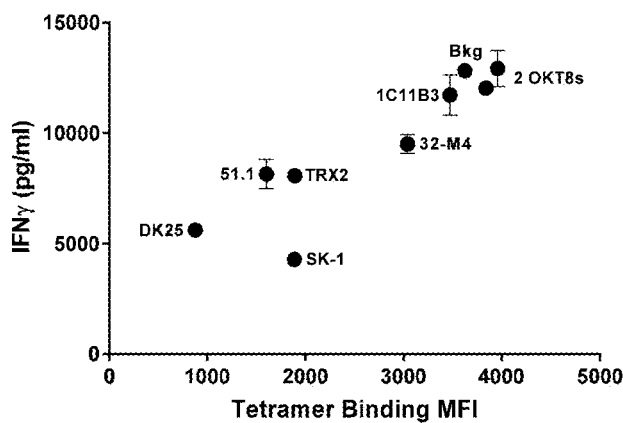

FIG. 86 depicts the correlation between IFNγ release and tetramer binding by T cells.

FIG. 87 depicts sequences for XENP24736, an illustrative CD8-targeted IL-15/Rα-Fc fusion with anti-CD8 Fab arm based on phage-derived 1C11B3. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

Figure 88A:
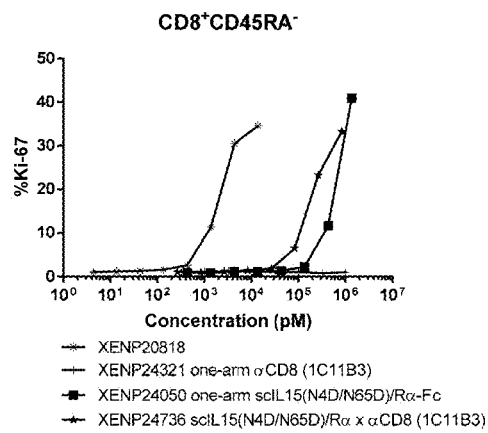
Figure 88B:
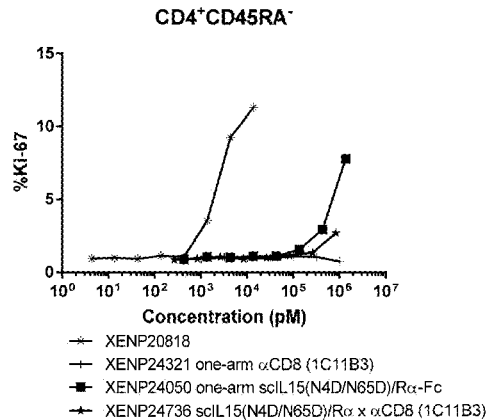

FIG. 88A-88B depicts percentage of (FIG. 88A) CD8+CD45RA− T cells and (FIG. 88B) CD4+CD45RA− T cells expressing Ki67 in human PBMCs treated with indicated test articles.

FIG. 89 depicts OKT8 variable regions, murine or humanized as indicated. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 90 depicts the sequences for XENP15075, a humanized anti-OKT8 mAb. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 91 depicts an illustrative one-arm anti-CD8 mAb with Fab arms based on humanized OKT8 variable regions as depicted in FIG. 89. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIGS. 92A-92C depict illustrative CD8-targeted IL-15/Rα-Fc fusions with anti-CD8 Fab arms based on murine or humanized OKT8 variable regions as depicted in FIG. 89. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

Figure 93A:
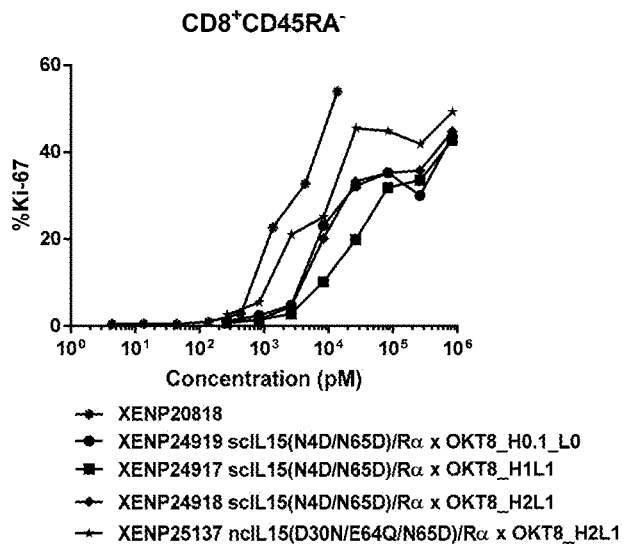
Figure 93B:
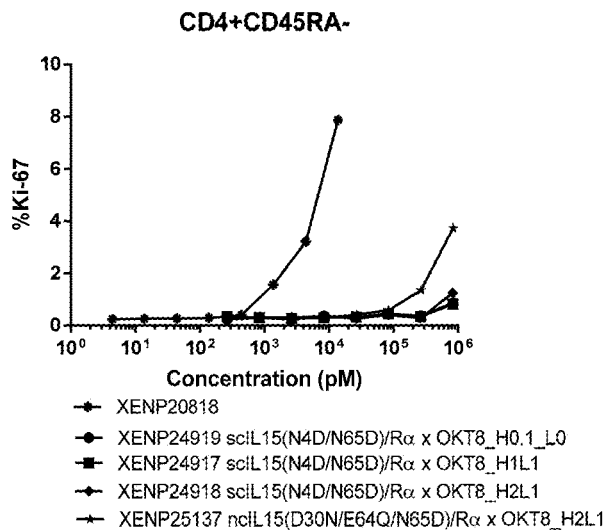

FIGS. 93A-93B depict percentage of (FIG. 93A) CD8+CD45RA− T cells and (FIG. 93B) CD4+CD45RA− T cells expressing Ki67 in human PBMCs treated with CD8-targeted IL-15/Rα-Fc fusions with humanized OKT8 binding domain.

Figure 94A:
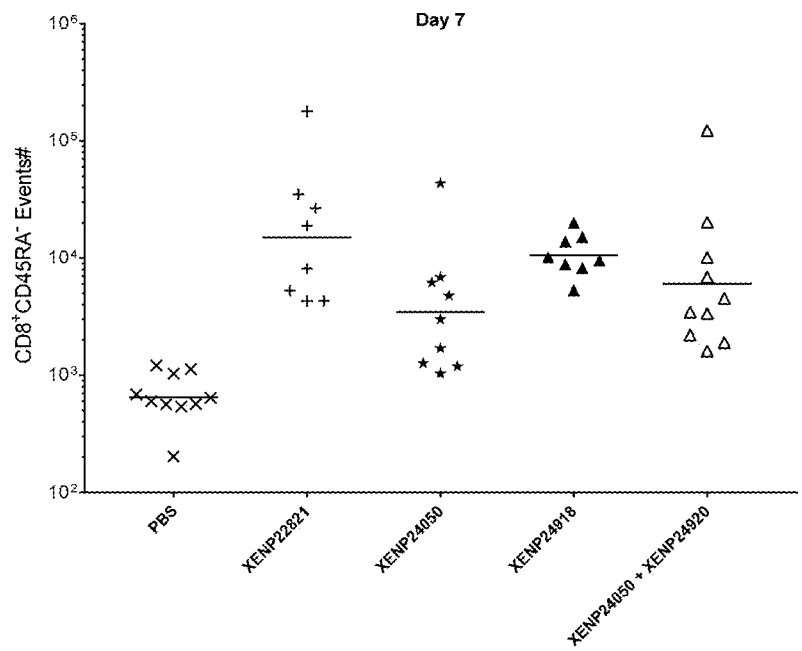
Figure 94B:
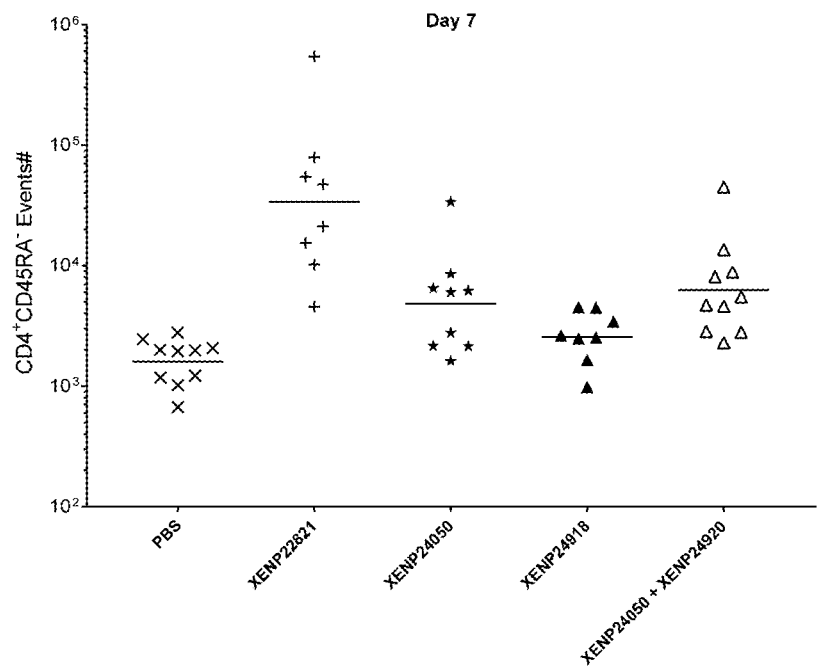

FIGS. 94A-94C depict (FIG. 94A) CD8+CD45RA− T cell counts, (FIG. 94B) CD4+CD45RA− T cell counts, and (FIG. 94C) CD8+/CD4+ T cell ratio in blood of human PBMC-engrafted NSG-mice on Day 7.

FIGS. 95A-95B depicts variant variable heavy regions based on OKT8_H2 (Humanized Variable Heavy V2) as depicted in FIG. 89 and variant variable light regions based on OKT8_H1 (Humanized Variable Light V1) as depicted in FIG. 89. Each of the variable heavy regions depicted herein may be combined with any of the variable light regions depicted in this Figure as well as those depicted in 89. Each of the variable light regions depicted herein may be combined with any of the variable heavy regions depicted in this Figure as well as those depicted in FIG. 89. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 96 depicts the dissociation constant ($K_D$), dissociation rate ($k_d$), and association rate ($k_a$) of illustrative cyno CD8 affinity engineered OKT8_H2L1 for human and cyno CD8. The molecules depicted here are one-arm mAbs using having an empty-Fc and a Fab, wherein the Fab arms comprise variable regions as depicted in FIGS. 89 and 95. For example, the Fab arm of XENP26009 has OKT8_H2.152 Variable Heavy and OKT8_L1.103 Variable Light.

FIG. 97A-97B depicts illustrative CD8-targeted IL-15/Rα-Fc fusions with anti-CD8 Fab arms based on cyno-affinity engineered (HuCy) OKT8 variable regions as depicted in FIG. 95. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

Figure 98A:
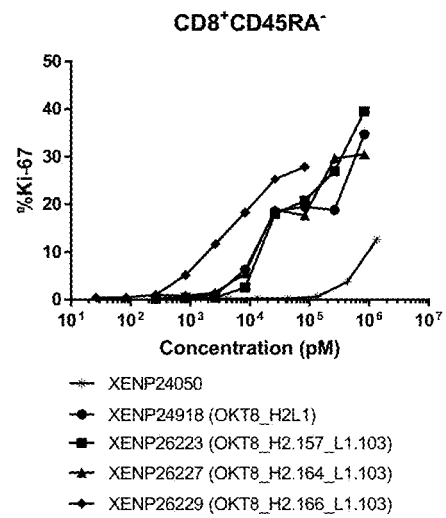
Figure 98B:
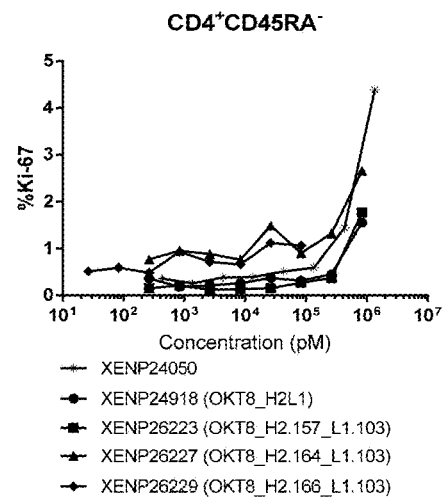

FIGS. 98A-98B depict percentage of (FIG. 98A) CD8+ CD45RA− T cells and (FIG. 98B) CD4+CD45RA− T cells expressing Ki67 in human PBMCs treated with CD8-targeted IL-15/Rα-Fc fusions with cyno affinity-engineered humanized OKT8 binding domains.

Figure 99A:
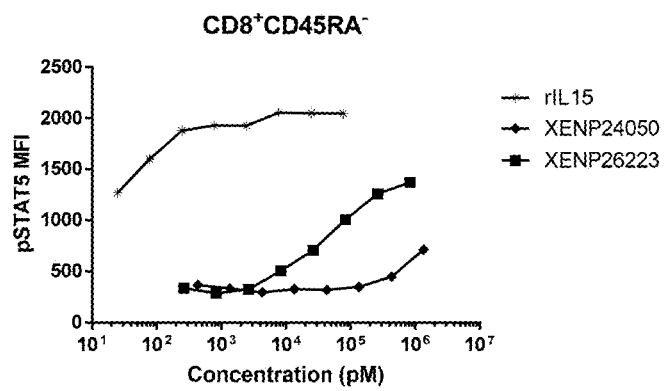
Figure 99B:
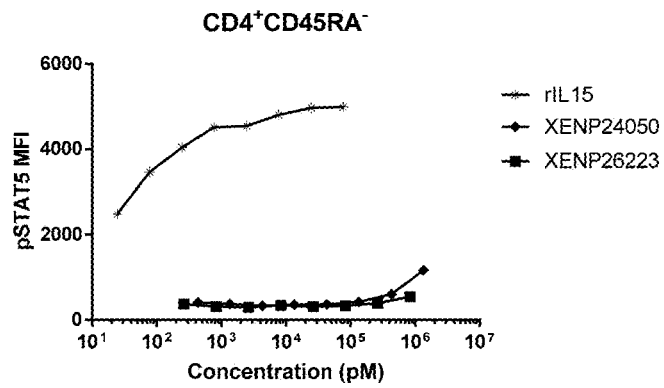
Figure 100A:
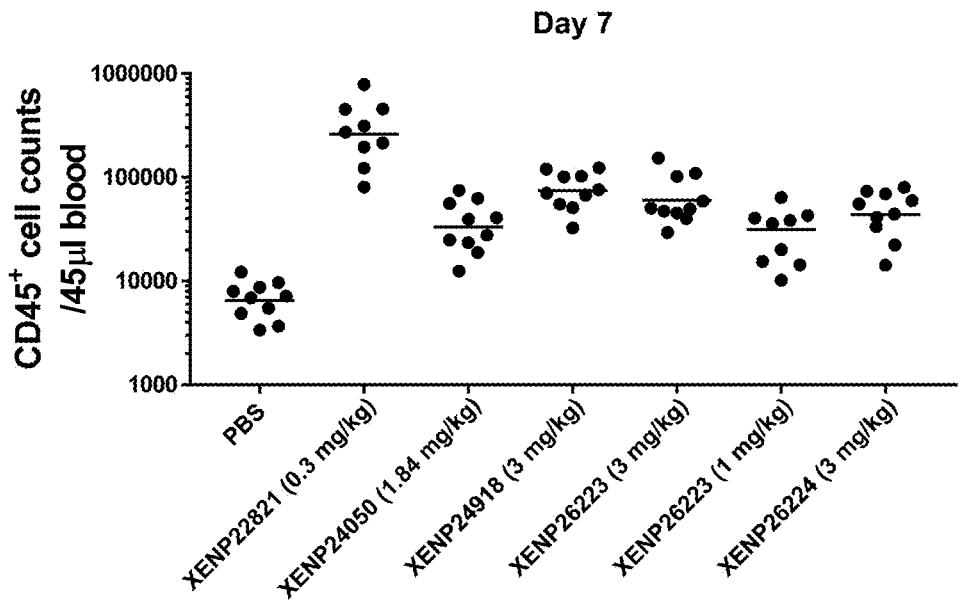
Figure 100B:
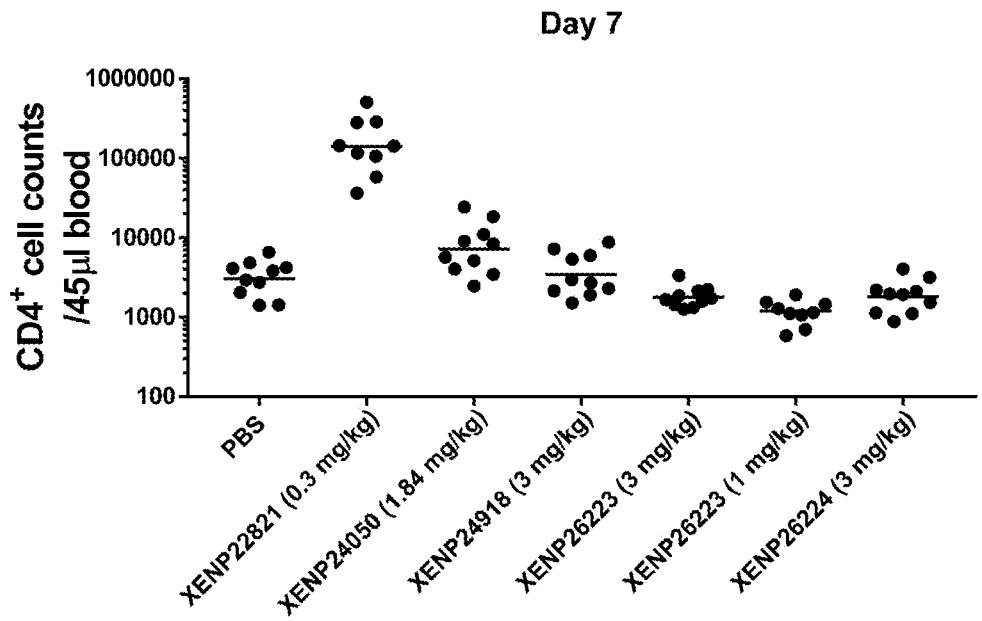
Figure 100C:
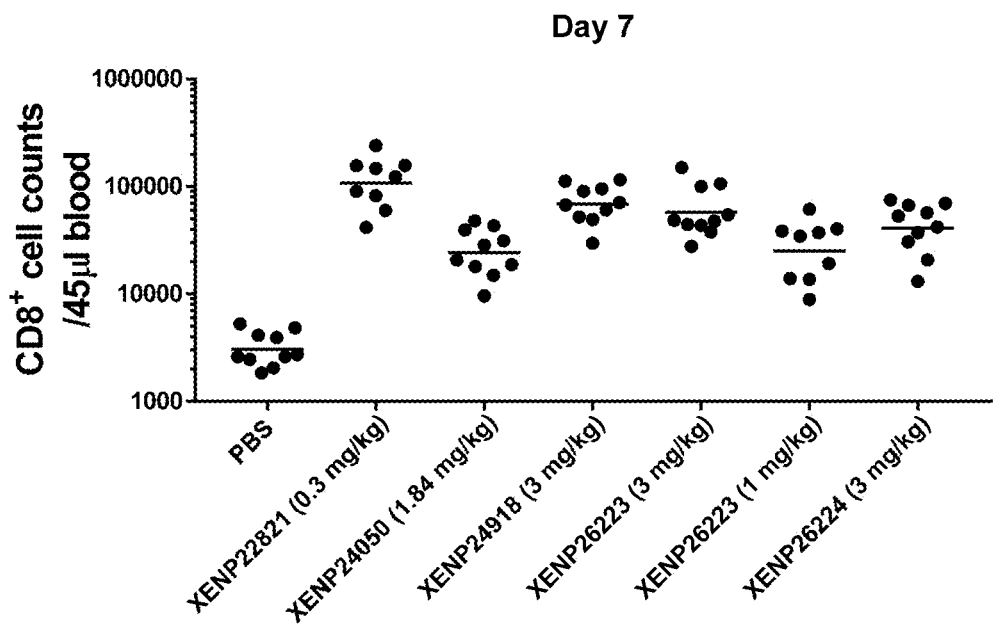
Figure 100D:
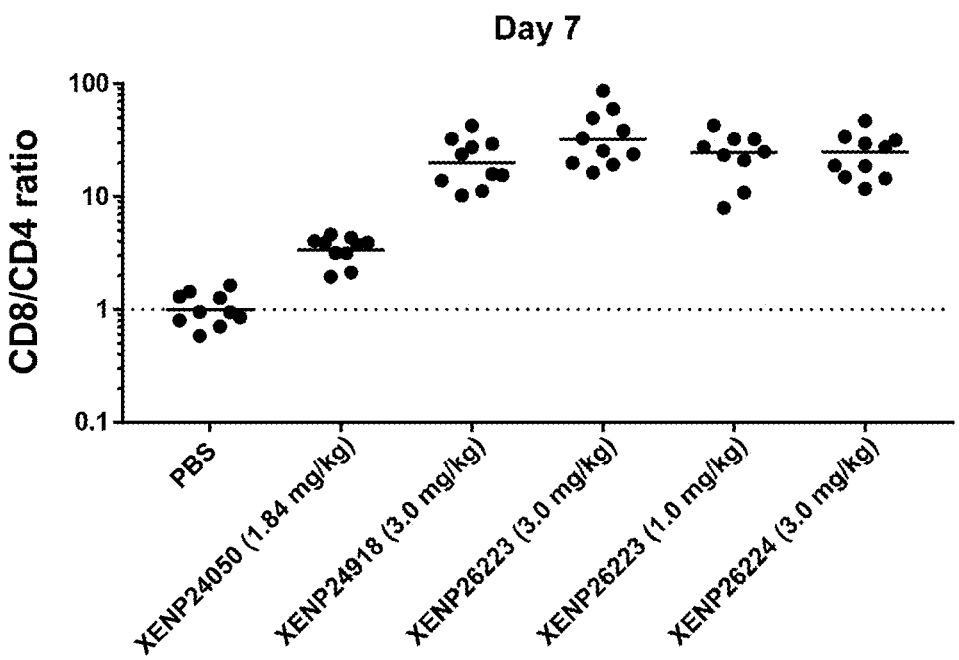

FIGS. 99A-99B depict STAT5 phosphorylation on (FIG. 99A) CD8+CD45RA− T cells and (FIG. 99B) CD4+ CD45RA− T cells in human PBMCs treated with CD8-targeted IL-15/Rα-Fc fusions with cyno affinity-engineered humanized OKT8 binding domains.

FIGS. 100A-100D depict (FIG. 100A) CD45+ cell count, (FIG. 100B) CD4+ T cell count, (FIG. 100C) CD8+ T cell count, and (FIG. 100D) CD8+/CD4+ T cell ratio in blood of human PBMC-engrafted NSG mice on Day 7 after dosing with CD8-targeted IL-15/Rα-Fc fusions with cyno affinity-engineered humanized OKT8 binding domains.

Figure 101A:
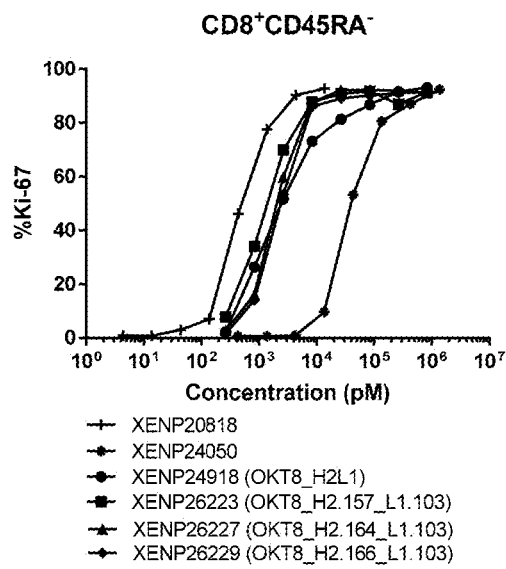
Figure 101B:
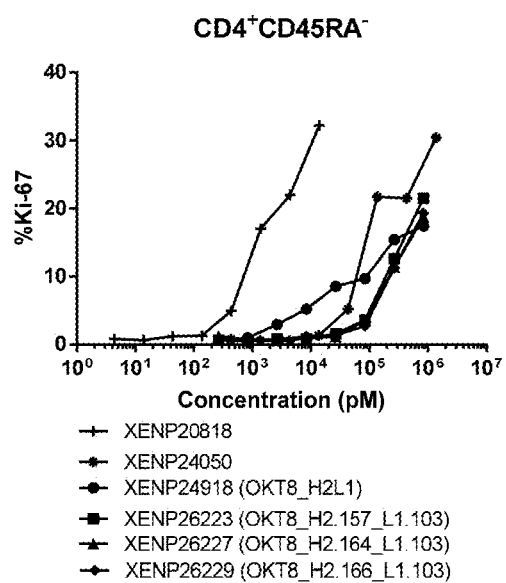
Figure 103A:
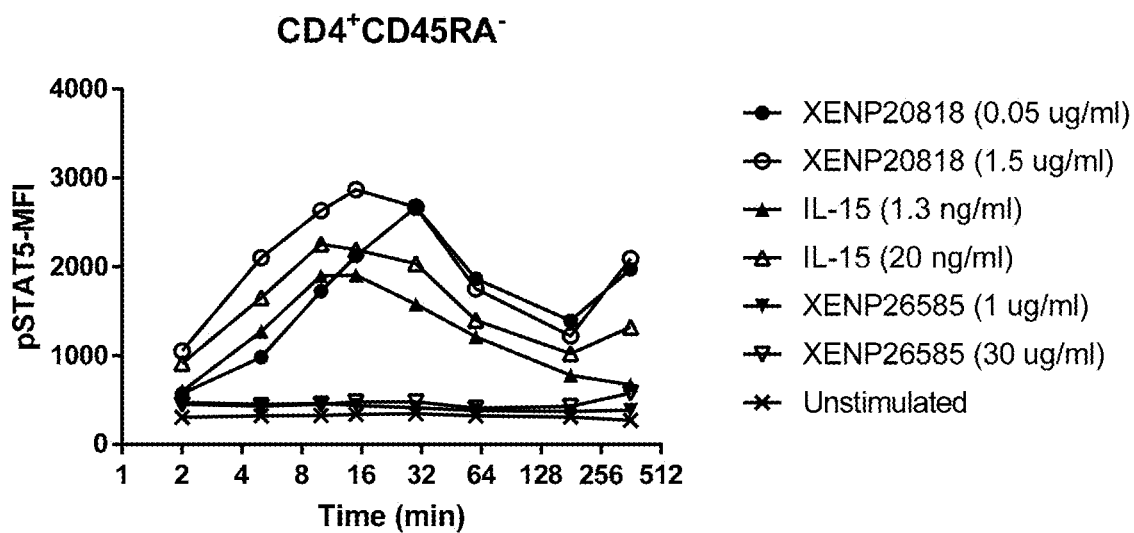
Figure 103B:
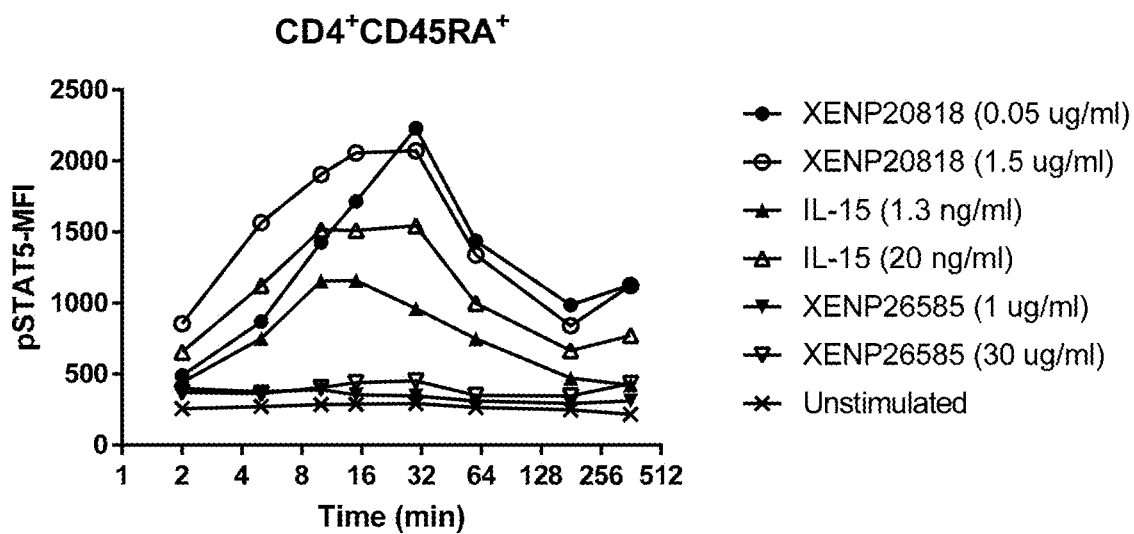
Figure 103C:
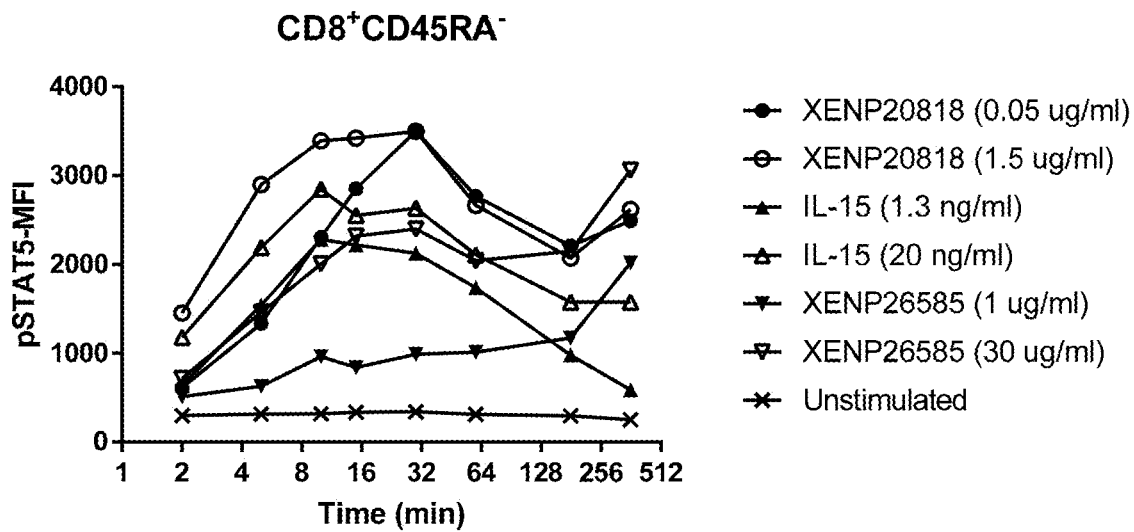
Figure 103D:
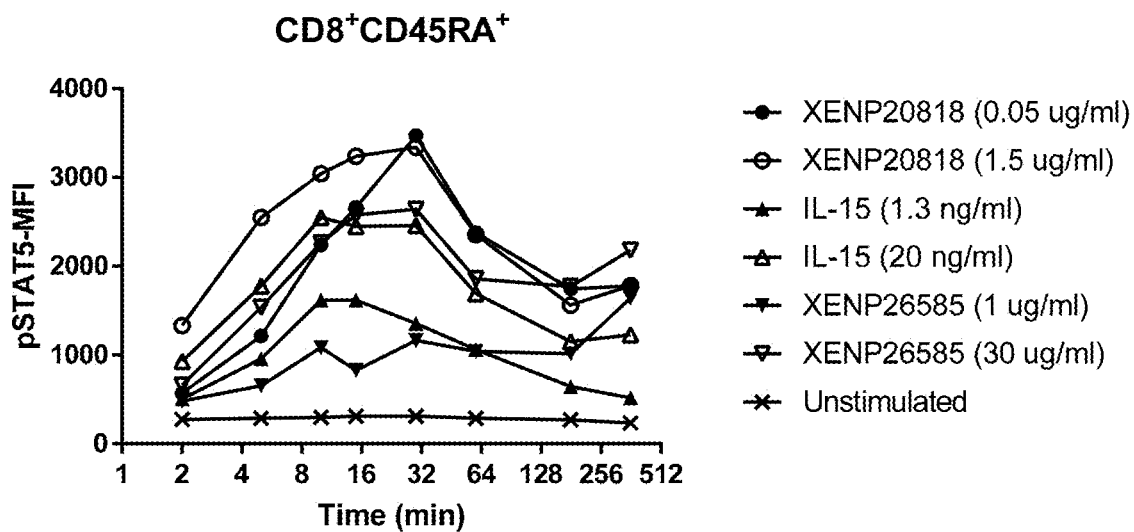
Figure 103E:
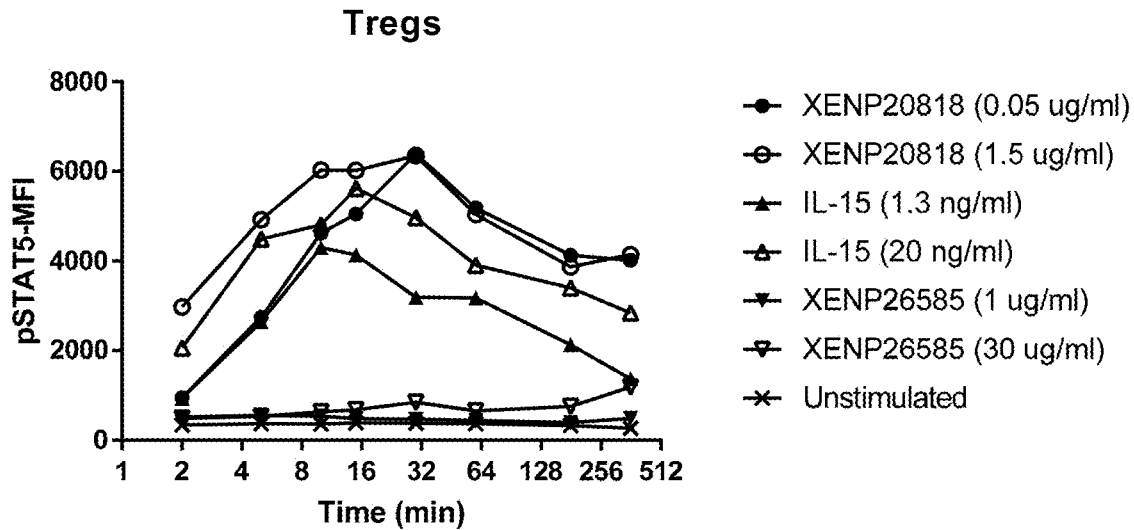
Figure 103F:
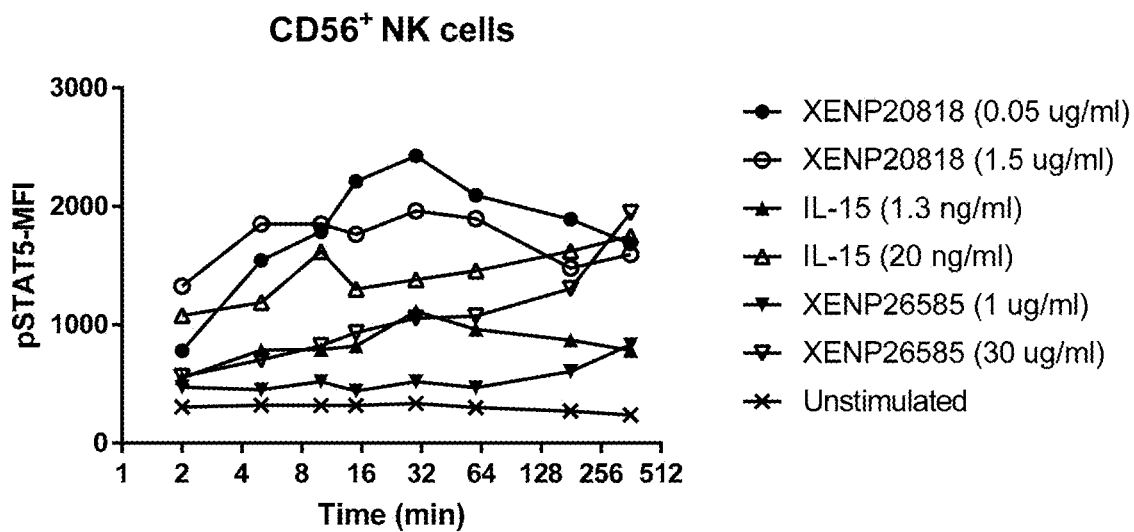

FIGS. 101A-101B depict percentage of (FIG. 101A) CD8+CD45RA− T cells and (FIG. 101B) CD4+CD45RA− T cells expressing Ki67 in cynomolgus PBMCs treated with CD8-targeted IL-15/Rα-Fc fusions with cyno affinity-engineered humanized OKT8 binding domains.

FIG. 102 depicts an illustrative CD8-targeted IL-15/Rα-Fc fusion with Xtend Fc. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

FIGS. 103A-103F depict STAT5 phosphorylation on (FIG. 103A) CD4+CD45RA− T cell, (FIG. 103B) CD4+ CD45RA+ T cell, (FIG. 103C) CD8+CD45RA− T cell, (FIG. 103D) CD8+CD45RA+ T cell, (FIG. 103E) Tregs, and (FIG. 103F) CD56− NK cells, over time by various concentrations of recombinant IL-15, WT IL-15/Rα-Fc (XENP20818), and illustrative CD8-targeted IL-15/Rα-Fc fusion (XENP26585).

Figure 104A:
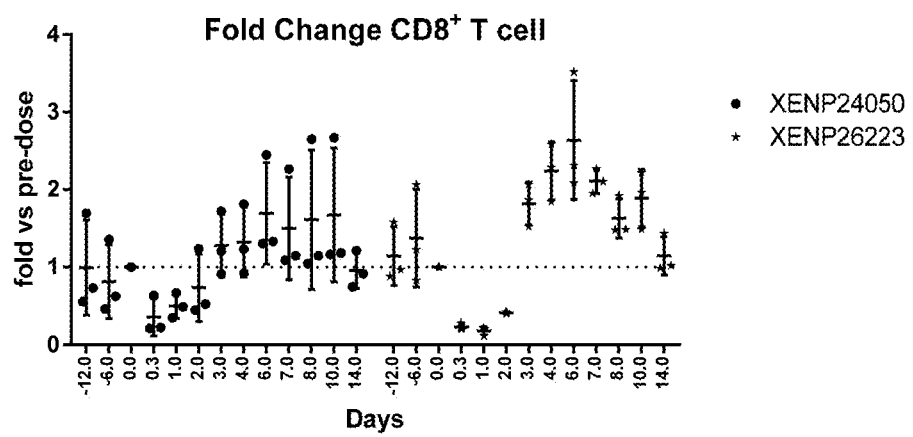
Figure 104B:
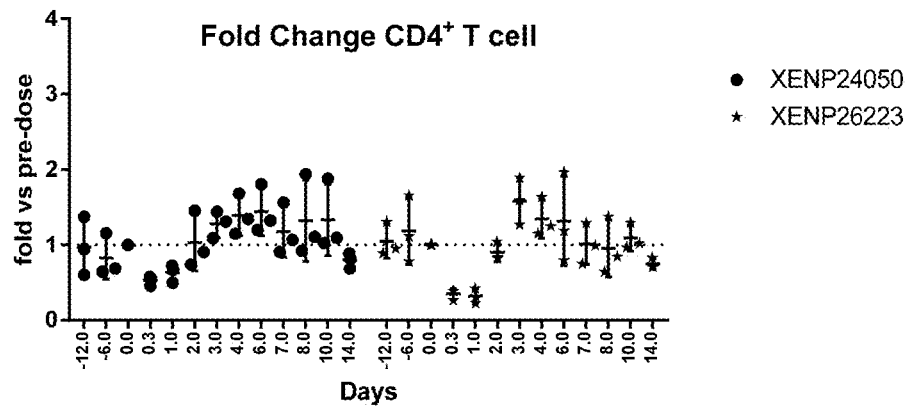

FIGS. 104A-104B depict fold change over time in (FIG. 104A) CD8+ T cell and (FIG. 104B) CD4+ T cell counts in cynomolgus peripheral blood following dosing with XENP24050 or XENP26223.

Figure 105A:
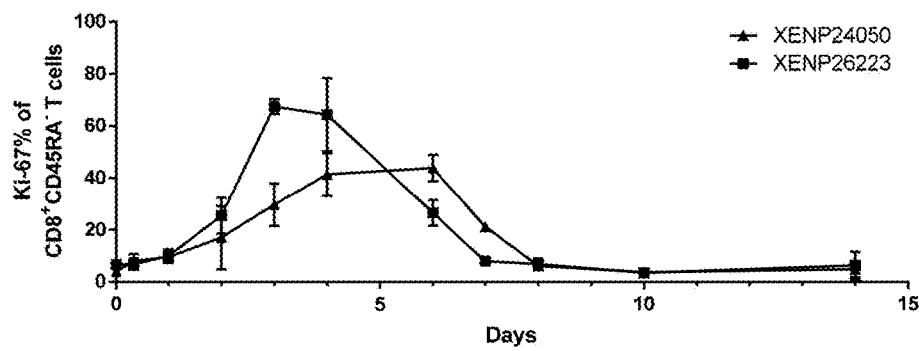
Figure 105B:
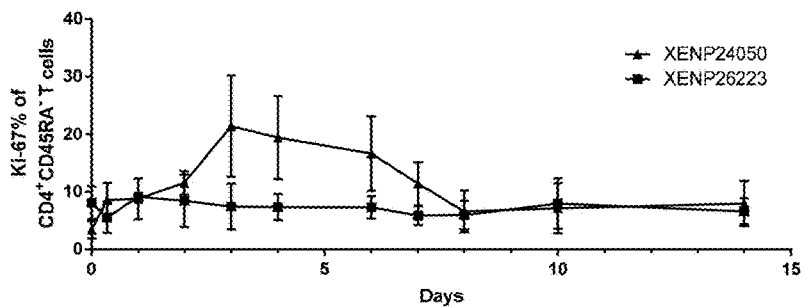

FIGS. 105A-105B depicts percentage of (FIG. 105A) CD8+ T cell and (FIG. 105B) CD4+ T cell expressing Ki67 in cynomolgus peripheral blood following dosing with XENP24050 or XENP26223.

Figure 106:
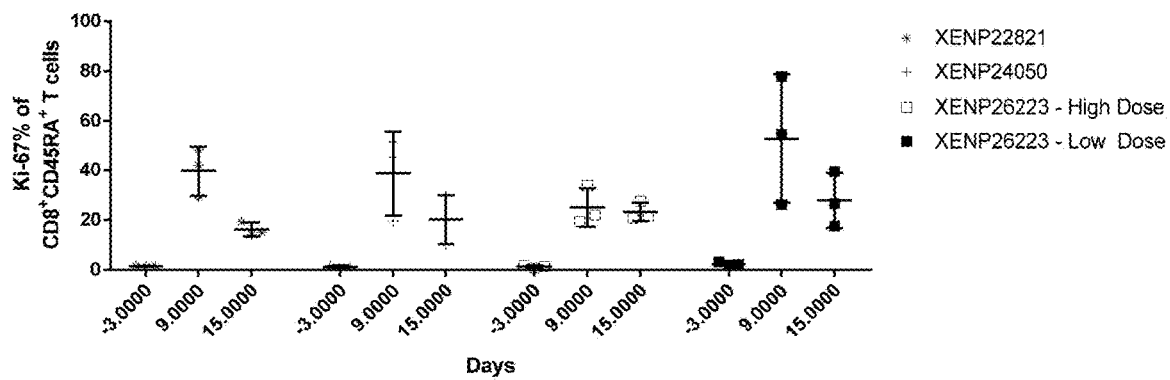

FIG. 106 depicts percentage of CD8+CD45RA− T cells expressing Ki67 in cynomolgus lymph nodes following dosing with XENP24050 or XENP26223.

Figure 107A:
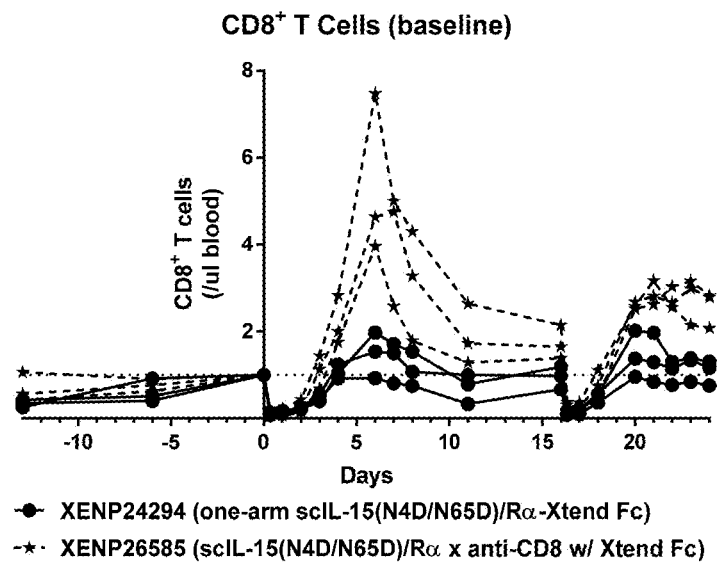
Figure 107B:
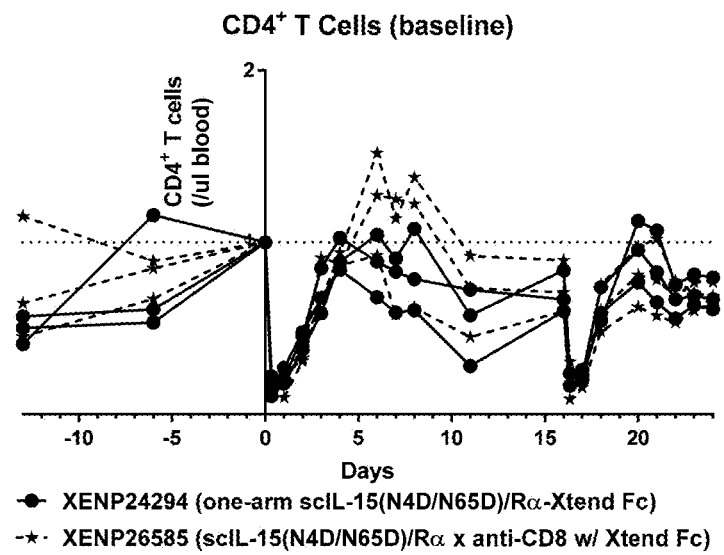
Figure 107C:
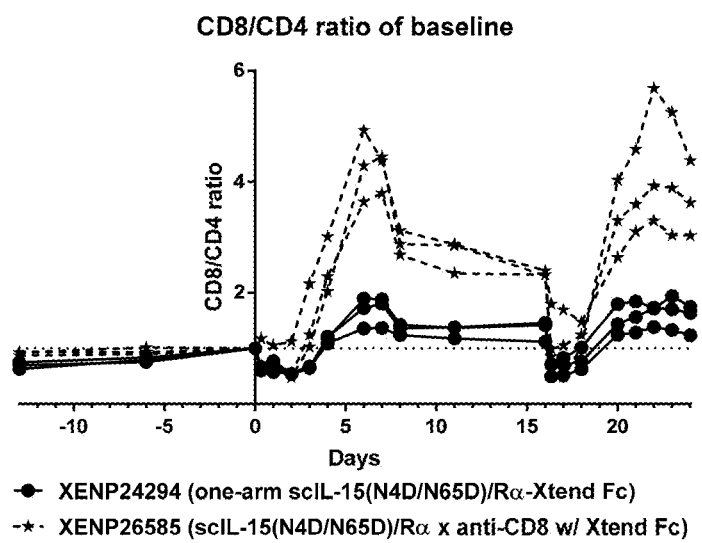

FIGS. 107A-107C depict (FIG. 107A) CD8+ T cell counts, (FIG. 107B) CD4+ T cell counts, and C) CD8+/CD4+ T cell ratio following dosing with one-arm reduced potency IL-15/Rα-Fc Fusion with Xtend Fc (XENP24294) and CD8-targeted IL-15/Rα-Fc fusion with Xtend Fc (XENP26585).

Figure 108A:
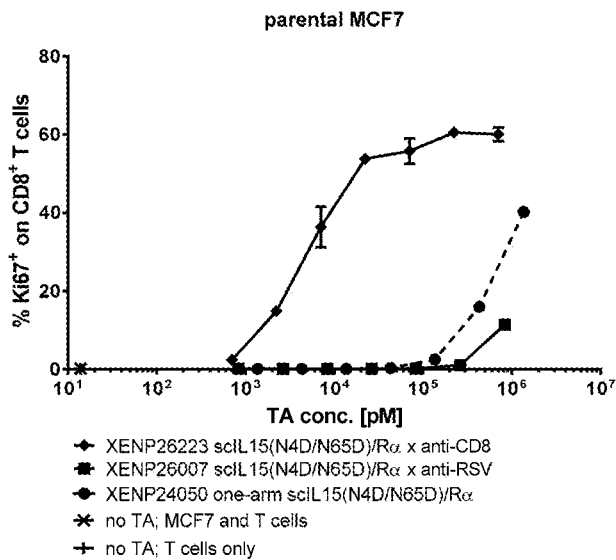
Figure 108B:
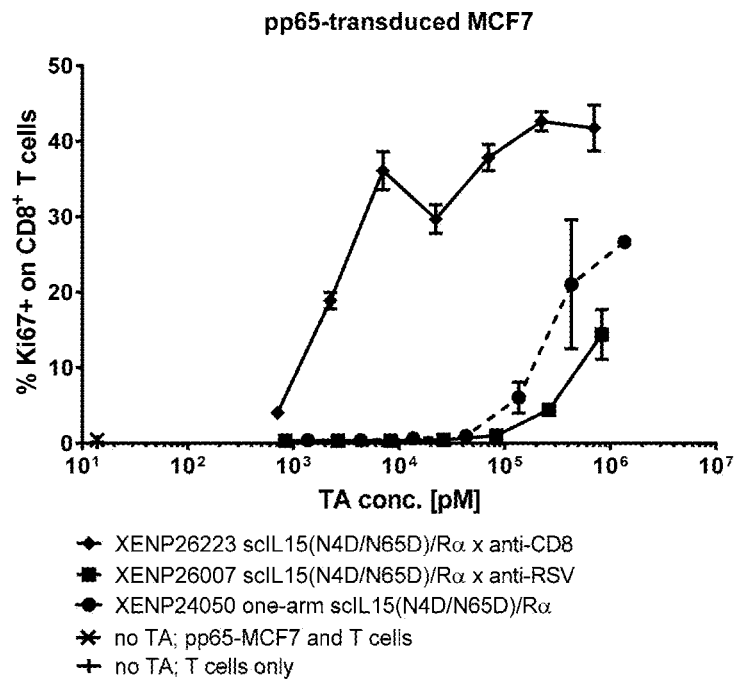

FIGS. 108A-108B depict percentage of CD8+ T cells positive for Ki67 in (FIG. 108A) Group 1 (purified T cells incubated with parental MCF-7 tumor cells and indicated test articles) and (FIG. 108B) Group 2 (purified T cells incubated with pp65-expressing MCF-7 tumor cells and indicated test articles).

Figure 109A:
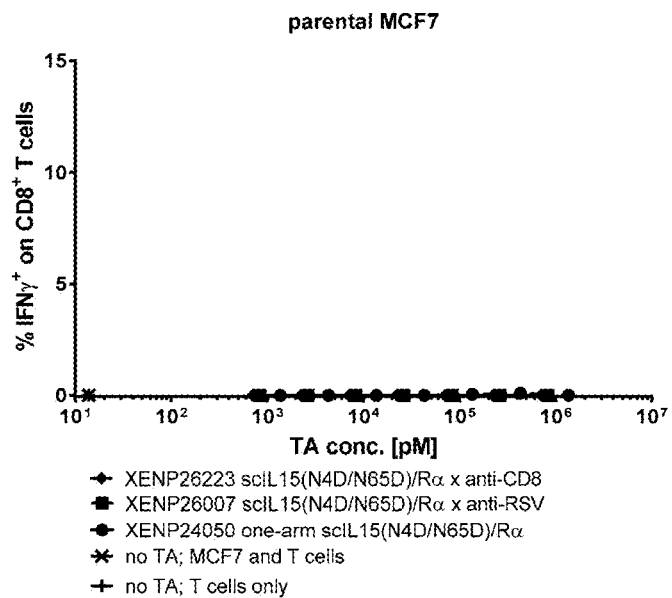
Figure 109B:
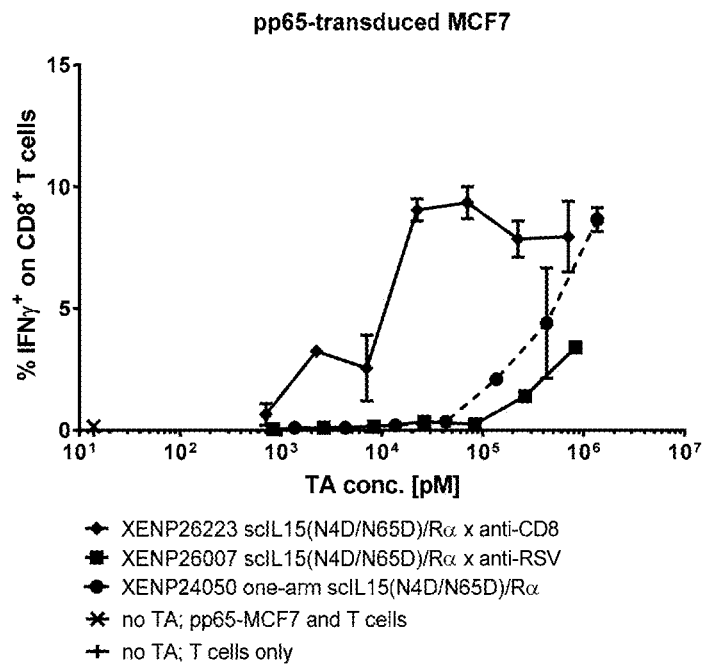

FIGS. 109A-109B depict percentage of CD8+ T cells positive for IFNγ in (FIG. 109A) Group 1 (purified T cells incubated with parental MCF-7 tumor cells and indicated test articles) and (FIG. 109B) Group 2 (purified T cells incubated with pp65-expressing MCF-7 tumor cells and indicated test articles).

Figure 110A:
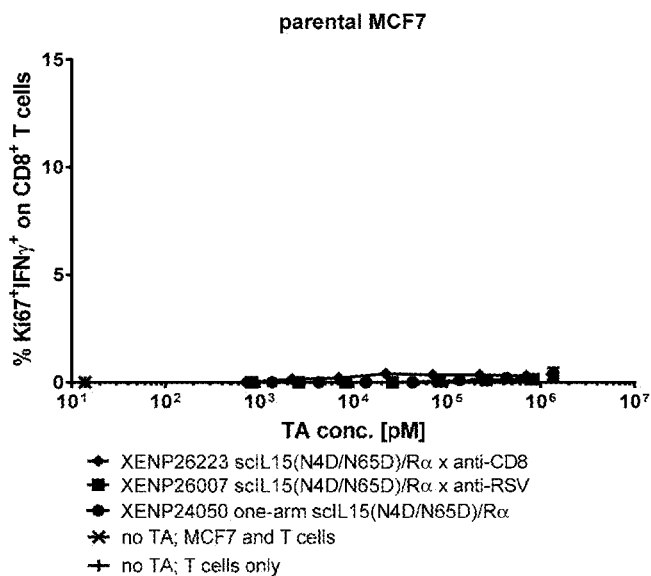
Figure 110B:
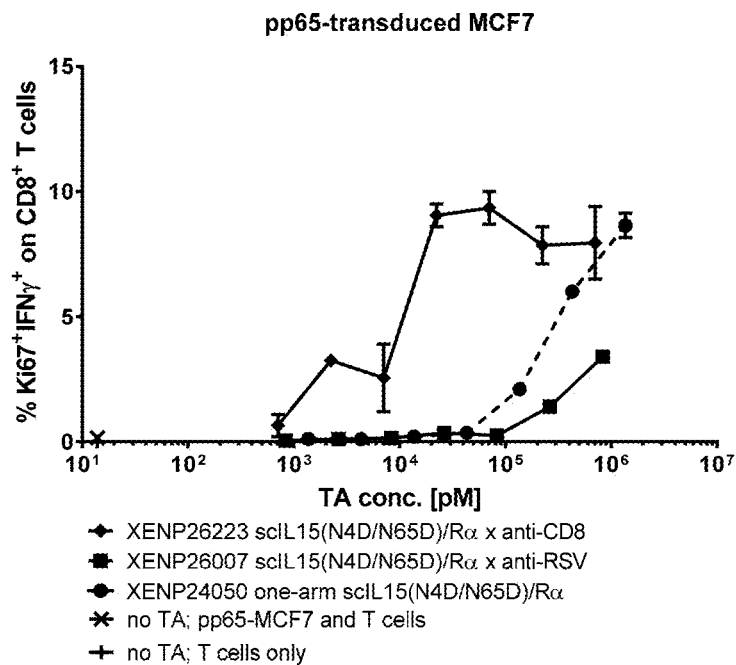

FIGS. 110A-110-B depict percentage of CD8+ T cells positive for Ki67 and IFNγ in (FIG. 110A) Group 1 (purified T cells incubated with parental MCF-7 tumor cells and indicated test articles) and (FIG. 110B) Group 2 (purified T cells incubated with pp65-expressing MCF-7 tumor cells and indicated test articles).

Figure 111A:
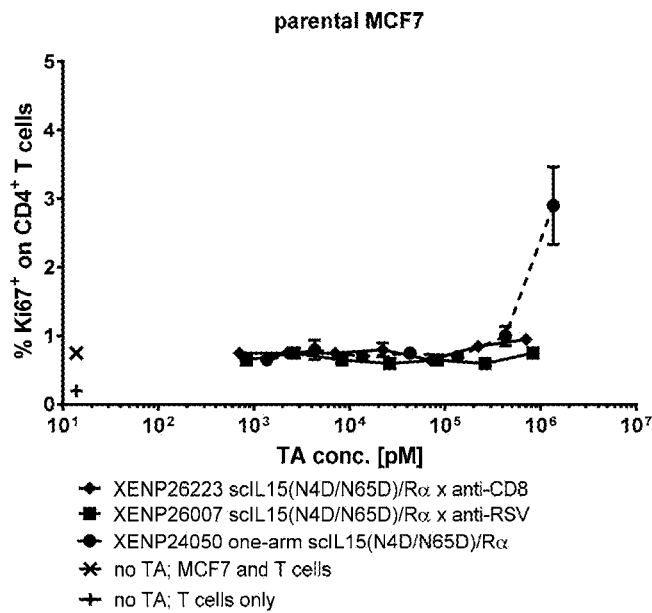
Figure 111B:
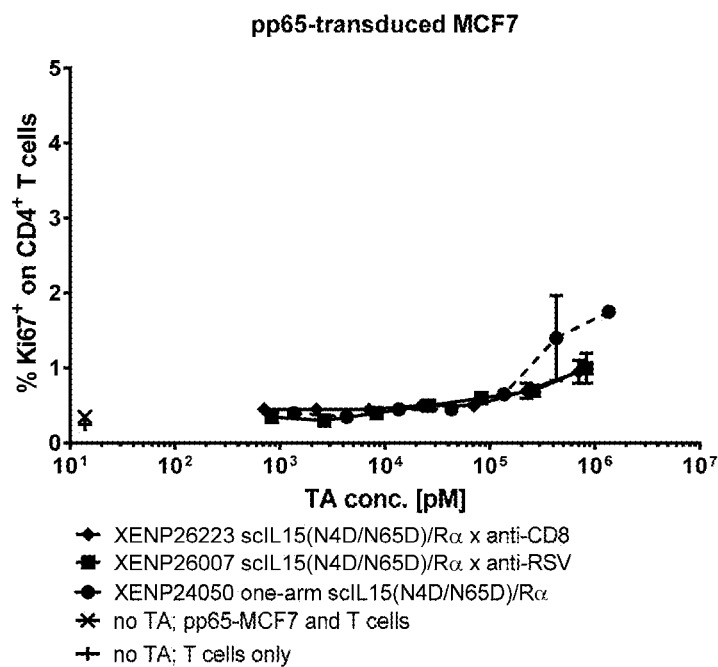

FIGS. 111A-111B depict percentage of CD4+ T cells positive for Ki67 in (FIG. 111A) Group 1 (purified T cells incubated with parental MCF-7 tumor cells and indicated test articles) and (FIG. 111B) Group 2 (purified T cells incubated with pp65-expressing MCF-7 tumor cells and indicated test articles).

Figure 112A:
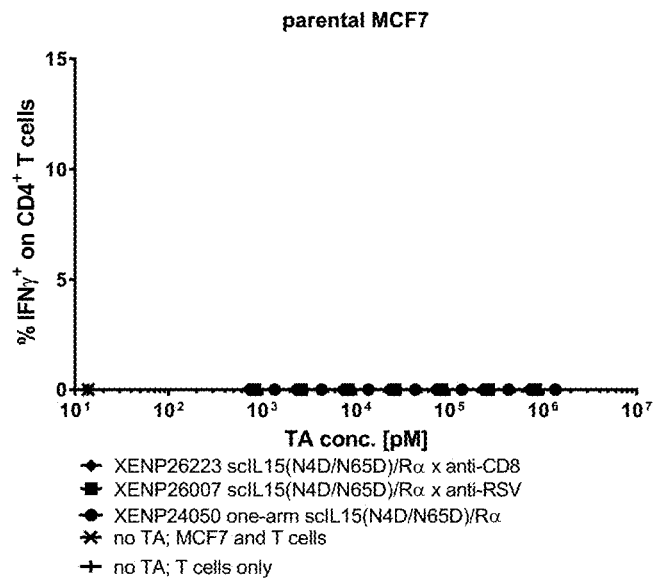
Figure 112B:
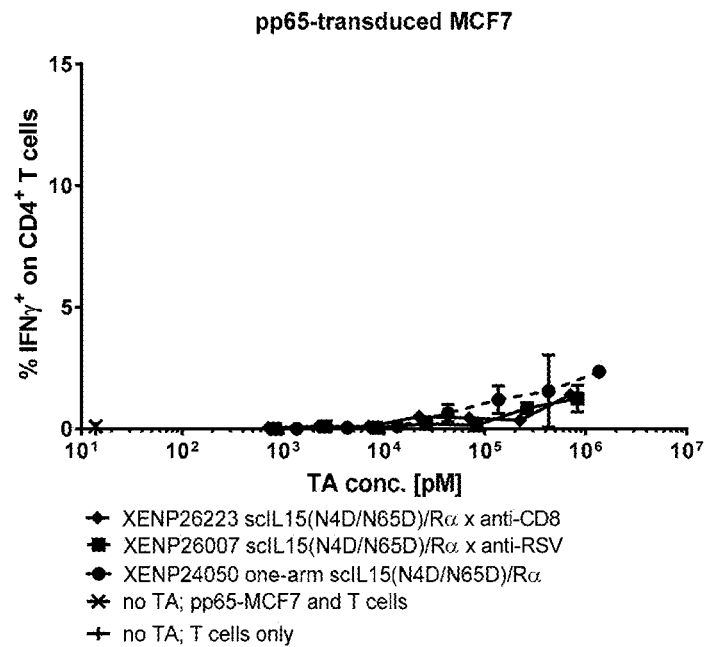

FIGS. 112A-112B depict percentage of CD4+ T cells positive for IFNγ in (FIG. 112A) Group 1 (purified T cells incubated with parental MCF-7 tumor cells and indicated test articles) and (FIG. 112B) Group 2 (purified T cells incubated with pp65-expressing MCF-7 tumor cells and indicated test articles).

Figure 113A:
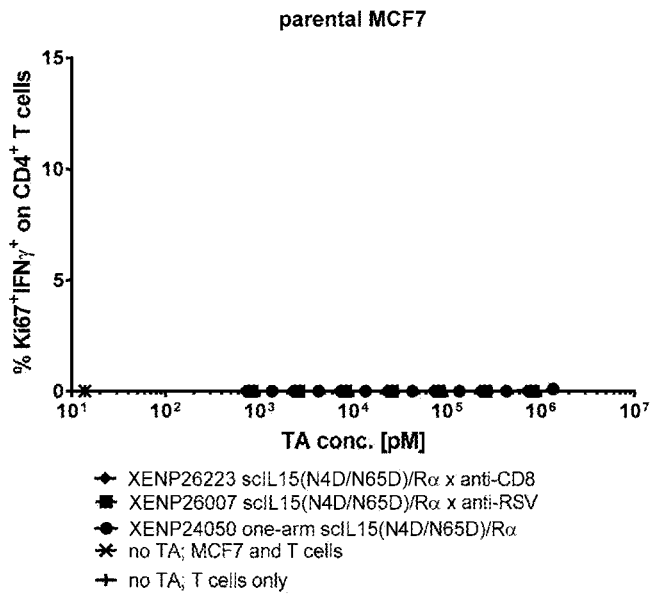
Figure 113B:
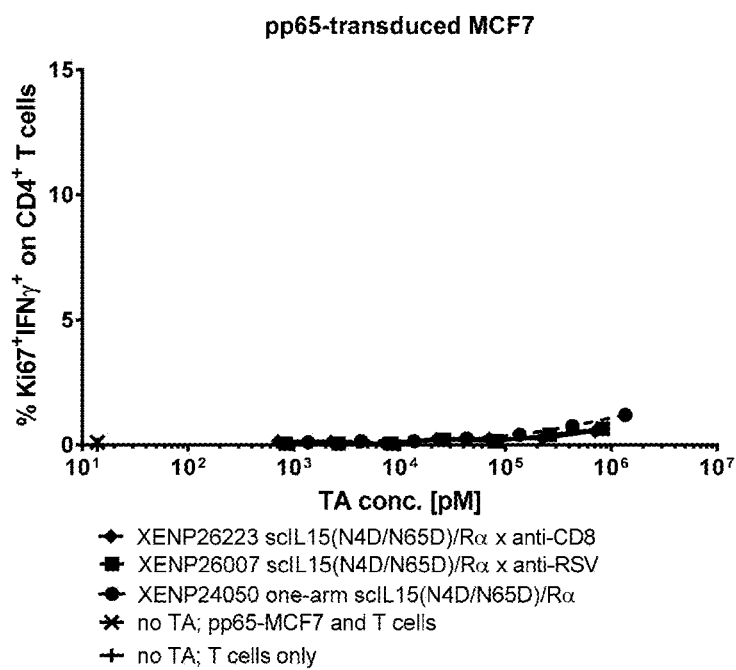

FIGS. 113A-113B depict percentage of CD4+ T cells positive for Ki67 and IFNγ in (FIG. 113A) Group 1 (purified T cells incubated with parental MCF-7 tumor cells and indicated test articles) and (FIG. 113B) Group 2 (purified T cells incubated with pp65-expressing MCF-7 tumor cells and indicated test articles).

Figure 114A:
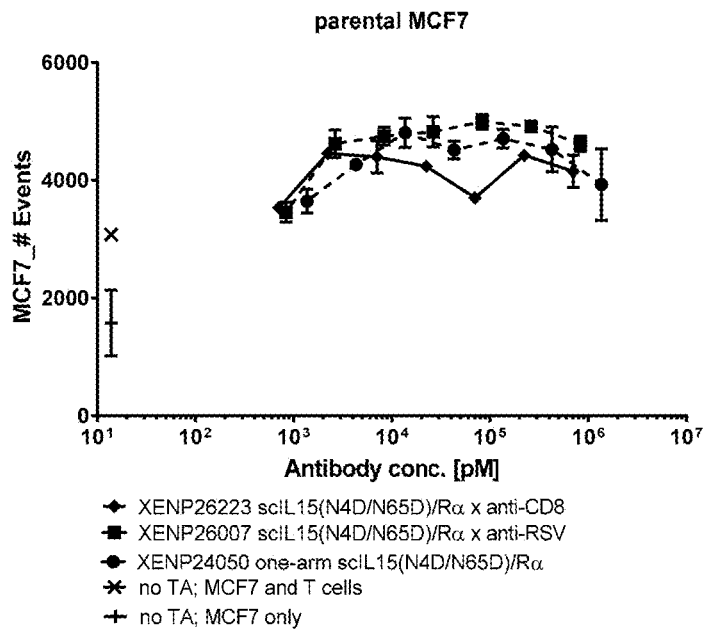
Figure 114B:
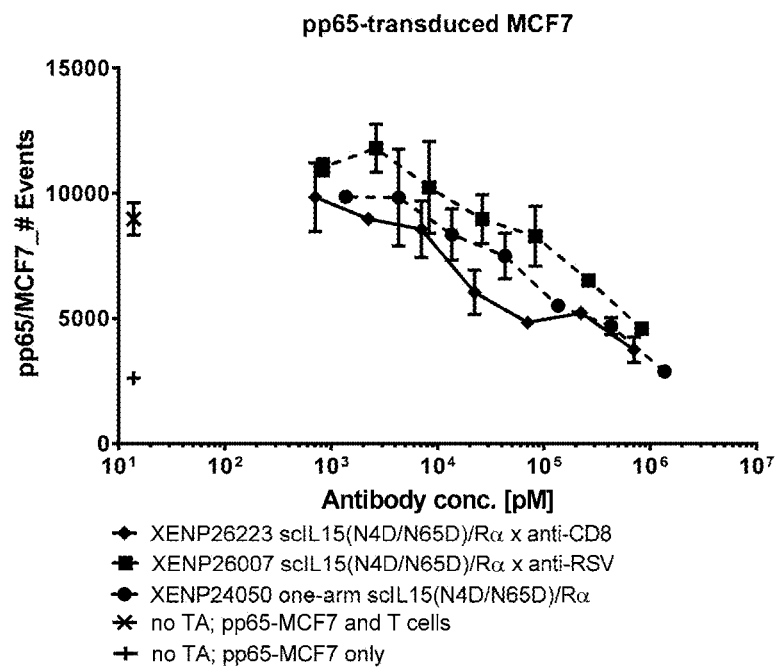

FIGS. 114A-114B depict remaining target cells [FIG. 114A: parental MCF-7 tumor cells; FIG. 114B: pp65-expressing MCF-7 tumor cells] following incubation with purified T cells and indicated test articles.

Figure 115A:
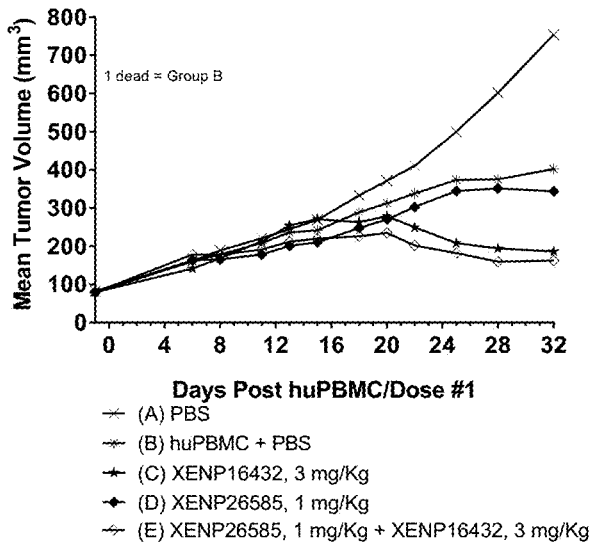
Figure 115B:
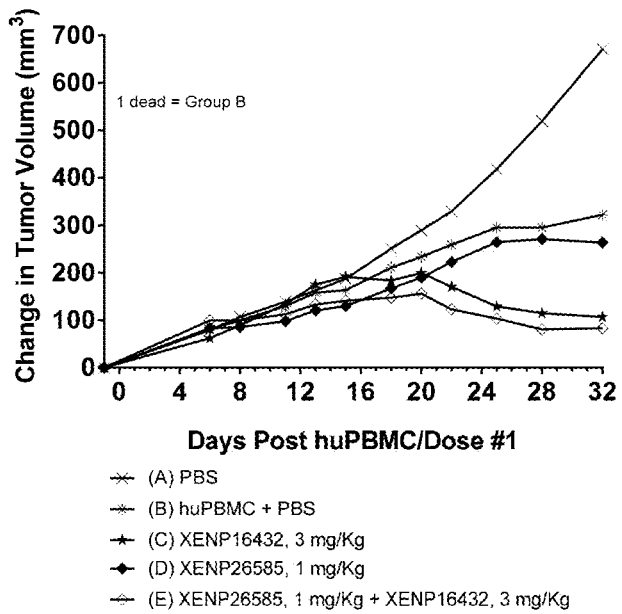
Figure 116A:
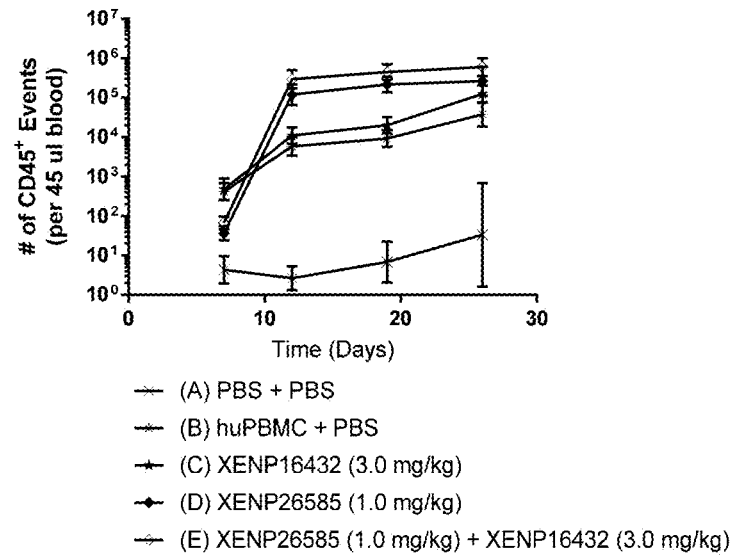
Figure 116B:
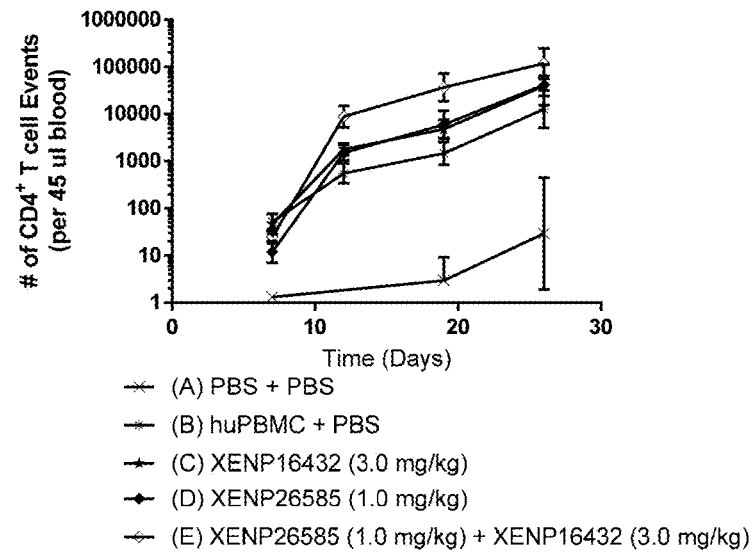
Figure 116C:
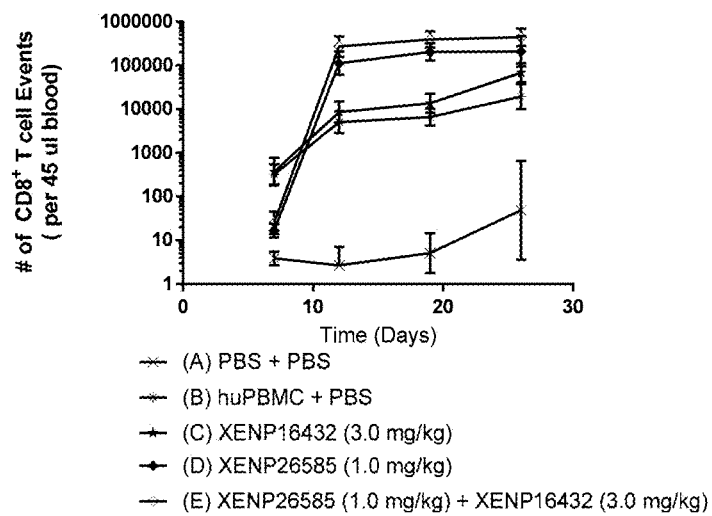
Figure 116D:
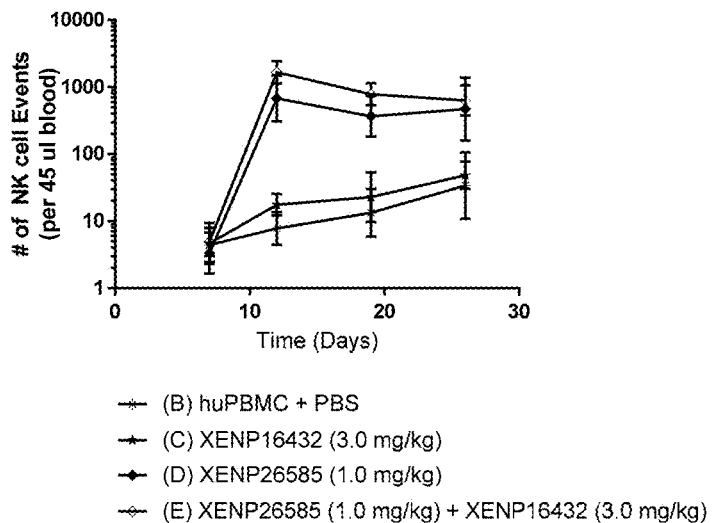
Figure 116E:
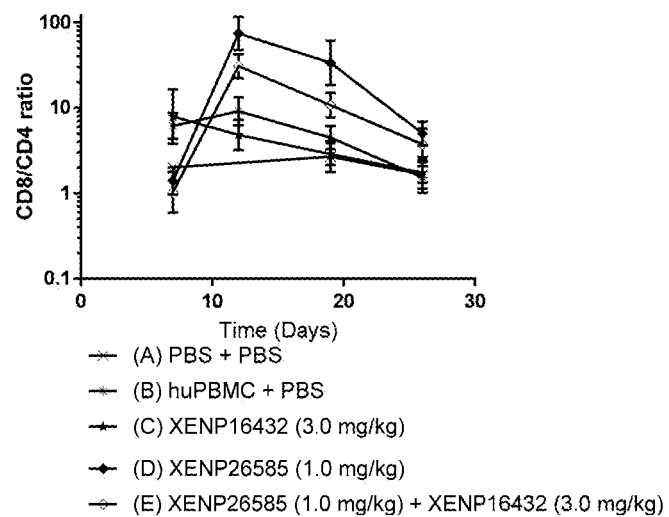

FIGS. 115A-115B depict (FIG. 115A) the mean tumor volume and (FIG. 115B) change in tumor volume in NSG mice engrafted with pp65-expressing MCF-7 cells, following engraftment with pp65 reactive huPBMC and treatment with indicated test articles.

FIGS. 116A-116E depict (FIG. 116A) CD45+ cell, (FIG. 116B) CD4+ T cell, (FIG. 116C) CD8+ T cell, and (FIG. 116D) NK cell counts as well as (FIG. 116E) CD8+/CD4+ T cell ratio in the whole blood of NSG mice engrafted with pp65-expressing MCF-7 cells following engraftment with pp65 reactive huPBMC and treatment with indicated test articles.

DETAILED DESCRIPTION OF THE INVENTION

I. Overview

The bifunctional heterodimeric Fc fusion proteins of the invention are useful to treat a variety of types of cancers. As will be appreciated by those in the art, recombinantly produced IL-15/IL-15Rα heterodimers can potently activate T cell. However, their short-half life hinders favorable dosing. The targeted IL-15/IL-15Rα×antigen binding domain heterodimeric Fc fusion proteins of the invention can lead to T cell activation, which in turn can result in greater immune response to cancerous cells and thus more effective treatment. Such targeted heterodimeric Fc fusion proteins can therefore be expected to find utility for treatment of a wide variety of tumor types.

As discussed below, there are a variety of ways that T cell activation can be measured. Functional effects of the bispecific checkpoint antibodies on NK and T-cells can be assessed in vitro (and in some cases in vivo, as described more fully below) by measuring changes in the following parameters: proliferation, cytokine release and cell-surface makers. For NK cells, increases in cell proliferation, cytotoxicity (ability to kill target cells as measured by increases in CD107a, granzyme, and perforin expression, or by directly measuring target cells killing), cytokine production (e.g., IFN-γ and TNF), and cell surface receptor expression (e.g., CD25) is indicative of immune modulation, e.g. enhanced killing of cancer cells. For T-cells, increases in proliferation, increases in expression of cell surface markers of activation (e.g., CD25, CD69, CD137, and PD1), cytotoxicity (ability to kill target cells), and cytokine production (e.g., IL-2, IL-4, IL-6, IFN-γ, TNF-α, IL-10, IL-17A) are indicative of immune modulation, e.g. enhanced killing of cancer cells. Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases in cell number and/or activity of at least one of regulatory T cells and cells (xii) increases of tumor immune infiltrates.

In some embodiments, the invention provides the use of bifunctional IL-15/IL-15Rα×antigen binding domain heterodimeric Fc fusion proteins to perform one or more of the following in a subject in need thereof: (a) upregulating pro-inflammatory cytokines; (b) increasing T-cell proliferation, expansion or tumor infiltration; (c) increasing interferon-γ, TNF-α and other cytokine production by T-cells; (d) increasing IL-2 secretion; (e) stimulating antibody responses; (0 inhibiting cancer cell growth; (g) promoting antigenic specific T cell immunity; (h) promoting CD4+ and/or CD8+ T cell activation; (i) alleviating T-cell suppression; (j) promoting NK cell activity; (k) promoting apoptosis or lysis of cancer cells; and/or (l) cytotoxic or cytostatic effect on cancer cell.

The bifunctional heterodimeric Fc fusion proteins constructs are based on the self-assembling nature of the two Fc domains of the heavy chains of antibodies, e.g. two "monomers" that assemble into a "dimer". Heterodimeric Fc fusion proteins are made by altering the amino acid sequence of each monomer as more fully discussed below. Thus, the present invention is generally directed to the creation of heterodimeric Fc fusion proteins, which can co-engage antigens in several ways, relying on amino acid variants in the constant regions that are different on each chain to promote heterodimeric formation and/or allow for ease of purification of heterodimers over the homodimers.

A major obstacle in the formation of the bifunctional heterodimeric Fc fusion proteins is the difficulty in purifying the heterodimeric fusion proteins away from the homodimeric fusion proteins and/or biasing the formation of the heterodimer over the formation of the homodimers. To solve this issue, there are a number of mechanisms that can be used to generate the heterodimers of the present invention. In addition, as will be appreciated by those in the art, these mechanisms can be combined to ensure high heterodimerization. Thus, amino acid variants that lead to the production of heterodimeric antibodies are referred to as "heterodimerization variants". As discussed below, heterodimerization variants can include steric variants (e.g., the "knobs and holes" or "skew" variants described below and the "charge pairs" variants described below) as well as "pI variants", which allows purification of homodimers away from heterodimers.

One mechanism, generally referred to in the art as "knobs and holes" ("KIH") or sometimes herein as "skew" variants, referring to amino acid engineering that creates steric and/or electrostatic influences to favor heterodimeric formation and disfavor homodimeric formation can also optionally be used, as described in Ridgway et al., Protein Engineering 9(7):617 (1996); Atwell et al., J. Mol. Biol. 1997 270:26; U.S. Pat. No. 8,216,805, U.S. Publication No. 2012/0149876, all of which are hereby incorporated by reference in their entirety. The Figures identify a number of "monomer A—monomer B" pairs that include "knobs and holes" amino acid substitutions. In addition, as described in Merchant et al., Nature Biotech. 16:677 (1998), these "knobs and hole" mutations can be combined with disulfide bonds to skew formation to heterodimerization. Of use in the present invention are T366S/L368A/Y407V paired with T366W, as well as this variant with a bridging disulfide, T366S/L368A/Y407V/Y349C paired with T366W/S354C, particularly in combination with other heterodimerization variants including pI variants as outlined below.

An additional mechanism that finds use in the generation of heterodimeric antibodies is sometimes referred to as "electrostatic steering" or "charge pairs" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R and others shown in the Figures.

In the present invention, in some embodiments, pI variants are used to alter the pI of one or both of the monomers and thus allowing the isoelectric separation of A-A, A-B and B-B dimeric proteins.

In the present invention, there are several basic mechanisms that can lead to ease of purifying heterodimeric proteins; one relies on the use of pI variants, such that each monomer has a different pI, thus allowing the isoelectric purification of A-A, A-B and B-B dimeric proteins. Alternatively, some scaffold formats, such as the "triple F" format, also allows separation on the basis of size. As is further outlined below, it is also possible to "skew" the formation of heterodimers over homodimers. Thus, a combination of steric heterodimerization variants and pI or charge pair variants find particular use in the invention.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B can be changed, with the pI of monomer A increasing and the pI of monomer B decreasing. As is outlined more fully below, the pI changes of either or both monomers can be done by removing or adding a charged residue (e.g., a neutral amino acid is replaced by a positively or negatively charged amino acid residue, e.g., glycine to glutamic acid), changing a charged residue from positive or negative to the opposite charge (e.g. aspartic acid to lysine) or changing a charged residue to a neutral residue (e.g., loss of a charge; lysine to serine). A number of these variants are shown in the Figures. In addition, suitable pI variants for use in the creation of heterodimeric antibodies herein are those that are isotypic, e.g., importing pI variants from different IgG isotypes such that pI is changed without introducing significant immunogenicity; see FIG. 29 from U.S. Publication No. 20140288275, hereby incorporated by reference in its entirety.

Accordingly, in this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A:B+ or wt A:B−), or by increasing one region and decreasing the other region (A+:B− or A−:B+).

Thus, in general, a component of some embodiments of the present invention are amino acid variants in the constant regions of antibodies that are directed to altering the isoelectric point (pI) of at least one, if not both, of the monomers of a dimeric protein to form "pI heterodimers" (when the protein is an antibody, these are referred to as "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the scFv and Fab of interest. That is, to determine which monomer to engineer or in which "direction" (e.g. more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some cases (depending on the format) heterodimers can be separated from homodimers on the basis of size (e.g. molecular weight). As shown in FIGS. 57A-57K, some formats result in heterodimers with different sizes.

In addition, as depicted in FIGS. 57A-57K, it will be recognized that it is possible that some antigens are bound bivalently (e.g., two antigen binding sites to a single antigen). As will be appreciated, any combination of Fab and scFvs can be utilized to achieve the desired result and combinations.

In the case where pI variants are used to achieve purified heterodimers over homodimers, by using the constant region(s) of the heavy chain(s), a more modular approach to designing and purifying multispecific proteins, including antibodies, is provided. Thus, in some embodiments, heterodimerization variants (including skew and purification heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g., the minimization or avoidance of non-human residues at any particular position.

A side benefit that can occur with this pI engineering is also the extension of serum half-life and increased FcRn binding. That is, as described in U.S. Pat. No. 8,637,641 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of bispecific antibodies, as the ability to either eliminate, minimize and distinguish when homodimers are present is significant. Similarly, the ability to reliably test the reproducibility of the heterodimeric protein production is important.

As will be appreciated by those in the art and discussed more fully below, the heterodimeric fusion proteins of the present invention can take on a wide variety of configurations, as are generally depicted in FIGS. 57A-57K. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. The present invention is directed to novel immunoglobulin compositions that engage an antigen and contain an Il-15/IL-15Rα complex.

Furthermore, as outlined herein, additional amino acid variants may be introduced into the bifunctional heterodimeric Fc fusion proteins of the invention, to add additional functionalities. For example, amino acid changes within the Fc region can be added (either to one monomer or both) to facilitate increased ADCC or CDC (e.g. altered binding to Fcγ receptors) as well as to increase binding to FcRn and/or increase serum half-life of the resulting molecules. As is further described herein and as will be appreciated by those in the art, any and all of the variants outlined herein can be optionally and independently combined with other variants.

Similarly, another category of functional variants are "Fcγ ablation variants" or "Fc knock out (FcKO or KO) variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, it is generally desirable to ablate FcγRIIIa binding to eliminate or significantly reduce ADCC activity. Suitable ablation variants are shown in FIG. 29.

II. Nomenclature

The bispecific antibodies of the invention are listed in several different formats. Each polypeptide is given a unique "XENP" number, although as will be appreciated in the art, a longer sequence might contain a shorter one. Some molecules have three polypeptides, so the XENP number, with the components, is used as a name. Thus, the molecule XENP24116, which is in bottle opener format, comprises three sequences, generally referred to as "XENP24116_human IL15Rα (sushi domain)_(GGGGS)5_human IL15 (N65D; single chain)-Fc", "XENP24116_51.1 [CD8]_H1L1 Fab-Fc heavy chain" and "XENP24116_51.1 [CD8]_H1L1 Fab-Fc light chain" or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab monomer has the full length sequence, the variable heavy sequence and the three CDRs of the variable heavy sequence; the light chain has a full length sequence, a variable light sequence and the three CDRs of the variable light sequence; and the scFv-Fc domain has a full length sequence, an scFv sequence, a variable light sequence, 3 light CDRs, a scFv linker, a variable heavy sequence and 3 heavy CDRs; note that all molecules herein with a scFv domain use a single charged scFv linker (+H), although others can be used. In addition, the naming nomenclature of particular variable domains uses a "Hx.xx_Ly.yy" type of format, with the numbers being unique identifiers to particular variable chain sequences. Thus, the variable domain of the Fab side of XENP26229 is "OKT8_H2.166 L1.103", which indicates that the variable heavy domain H2.166 was combined with the light domain L1.103. In the case that these sequences are used as scFvs, the designation "OKT8_H2.166_L1.103", indicates that the variable heavy domain H2.166 was combined with the light domain L1.103 and is in the vh-linker-vl orientation, from N- to C-terminus. This molecule with the identical sequence of the heavy and light variable domains but in the reverse order would be named "OKT8_L1.103_H2.166". Similarly, different constructs may "mix and match" the heavy and light chains as will be evident from the sequence listing and the Figures.

III. Definitions

In order that the application may be more completely understood, several definitions are set forth below. Such definitions are meant to encompass grammatical equivalents.

By "ablation" herein is meant a decrease or removal of binding and/or activity. Thus for example, "ablating FcγR binding" means the Fc region amino acid variant has less than 50% starting binding as compared to an Fc region not containing the specific variant, with less than 70-80-90-95-98% loss of binding being preferred, and in general, with the binding being below the level of detectable binding in a Biacore assay. Of particular use in the ablation of FcγR binding are those shown in FIG. 29. However, unless otherwise noted, the Fc monomers of the invention retain binding to the FcRn.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity. As is discussed herein, many embodiments of the invention ablate ADCC activity entirely.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g., the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y or 272Y refers to a variant polypeptide, in this case an Fc variant, in which the glutamic acid at position 272 is replaced with tyrosine. For clarity, a protein which has been engineered to change the nucleic acid coding sequence, but not to change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution. Substitutions can include naturally occurring amino acids and, in some cases, synthetic amino acids. Examples include U.S. Pat. No. 6,586,207; WO 98/48032; WO 03/073238; US2004-0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

By "amino acid insertion" or "insertion" as used herein is meant the addition of an amino acid residue or sequence at a particular position in a parent polypeptide sequence. For example, -233E designates an insertion of glutamic acid after position 233 and before position 234. Additionally, -233ADE or A233ADE designates an insertion of AlaAspGlu after position 233 and before position 234.

By "amino acid deletion" or "deletion" as used herein is meant the removal of an amino acid residue or sequence at a particular position in a parent polypeptide sequence. For example, E233-, E233#, E233( ) or E233del designates a deletion of glutamic acid at position 233. Additionally, EDA233- or EDA233# designates a deletion of the sequence GluAspAla that begins at position 233.

By "variant protein," "protein variant," or "variant" as used herein is meant a protein that differs from that of a parent protein by virtue of at least one modification. The protein variant may refer to the protein itself, a composition comprising the protein, the amino acid sequence that encodes it, or the DNA sequence that encodes it. Preferably, the protein variant has at least one amino acid modification compared to the parent protein, e.g. from about one to about seventy amino acid modifications, and preferably from about one to about five amino acid modifications compared to the parent. The modification can be an addition, deletion, or substitution.

As described below, in some embodiments the parent polypeptide, for example an Fc parent polypeptide, is a human wild type sequence, such as the heavy constant domain or Fc region from IgG1, IgG2, IgG3 or IgG4, although human sequences with variants can also serve as "parent polypeptides", for example the IgG1/2 hybrid of U.S. Publication No. 2006/0134105 can be included. The protein variant sequence herein will preferably possess at least about 80% identity with a parent protein sequence, and most preferably at least about 90% identity, more preferably at least about 95-98-99% identity.

Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and by "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain as compared to an Fc domain of human IgG1, IgG2 or IgG4.

The Fc variants of the present invention are defined according to the amino acid modifications that compose them. Thus, for example, N434S or 434S is an Fc variant with the substitution for serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, N434S/M428L is the same Fc variant as M428L/N434S, and so on. For all positions discussed in the present invention that relate to antibodies or derivatives and fragments thereof, unless otherwise noted, amino acid position numbering is according to the EU index. The EU index or EU index as in Kabat or EU numbering scheme refers to the numbering of the EU antibody. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference). See also Edelman et al., 1969, Proc Natl Acad Sci USA 63:78-85, hereby entirely incorporated by reference. The modification can be an addition, deletion, or substitution.

As used herein, by "protein" is meant at least two covalently attached amino acids, which includes proteins, polypeptides, oligopeptides and peptides. In addition, polypeptides that make up the antibodies of the invention may include synthetic derivatization of one or more side chains or termini, glycosylation, PEGylation, circular permutation, cyclization, linkers to other molecules, fusion to proteins or protein domains, and addition of peptide tags or labels. When a biologically functional molecule comprises two or more proteins, each protein may be referred to as a "monomer" or as a "subunit" or as a "domain"; and the biologically functional molecule may be referred to as a "complex".

By "residue" as used herein is meant a position in a protein and its associated amino acid identity. For example, asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains, generally on two different polypeptide chains (e.g. VH—CH1 on one chain and VL-CL on the other). Fab may refer to this region in isolation, or this region in the context of a bispecific antibody of the invention. In the context of a Fab, the Fab comprises an Fv region in addition to the CH1 and CL domains.

By "Fv" or "Fv fragment" or "Fv region" as used herein is meant a polypeptide that comprises the VL and VH domains of an ABD. Fv regions can be formatted as both Fabs (as discussed above, generally two different polypeptides that also include the constant regions as outlined above) and scFvs, where the vl and vh domains are combined (generally with a linker as discussed herein) to form an scFv.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or vl-linker-vh). In the sequences depicted in the sequence listing and in the figures, the order of the vh and vl domain is indicated in the name, e.g. H.X_L.Y means N- to C-terminal is vh-linker-vl, and L.Y_H.X is vl-linker-vh.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" or "Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. A n FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin (β2-microglobulin) and the heavy chain is encoded by the FcRn gene. Unless otherwise noted herein, FcRn or an FcRn protein refers to the complex of FcRn heavy chain with 132-microglobulin. A variety of Fc variants can be used to increase binding to the FcRn, and in some cases, to increase serum half-life. An "FcRn variant" is one that increases binding to the FcRn, and suitable FcRn variants are shown below. In general, unless otherwise noted, the Fc monomers of the invention retain binding to the FcRn (and, as noted below, can include amino acid variants to increase binding to the FcRn.

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent antigen binding domain" as used herein is meant an unmodified antigen binding domain polypeptide that is modified to generate a variant, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below.

By "Fc" or "Fc region" or "Fc domain" as used herein is meant the polypeptide comprising the CH2-CH3 domains of an IgG molecule, and in some cases, inclusive of the hinge. In EU numbering for human IgG1, the CH2-CH3 domain comprises amino acids 231 to 447, and the hinge is 216 to 230. Thus the definition of "Fc domain" includes both amino acids 231-447 (CH2-CH3) or 216-447 (hinge-CH2-CH3), or fragments thereof. An "Fc fragment" in this context may contain fewer amino acids from either or both of the N- and C-termini but still retains the ability to form a dimer with another Fc domain or Fc fragment as can be detected using standard methods, generally based on size (e.g. non-denaturing chromatography, size exclusion chromatography, etc.). Human IgG Fc domains are of particular use in the present invention, and can be the Fc domain from human IgG1, IgG2 or IgG4By "Fc" or "Fc region" or "Fc domain" as used herein is meant the polypeptide comprising the constant region of an antibody, in some instances, excluding all or a portion of the first constant region immunoglobulin domain (e.g., CH1) or a portion thereof, and in some cases, further excluding all or a portion of the hinge. Thus, an Fc can refer to the last two constant region immunoglobulin domains (e.g., CH2 and CH3) of IgA, IgD, and IgG, the last three constant region immunoglobulin domains of IgE and IgM, and optionally, all or a portion of the flexible hinge N-terminal to these domains. For IgA and IgM, Fc may include the J chain. For IgG, the Fc domain comprises immunoglobulin domains CH2 and CH3 (Cγ2 and Cγ3), and optionally all or a portion of the hinge region between CH1 (Cγ1) and CH2 (Cγ2). Although the boundaries of the Fc region may vary, the human IgG heavy chain Fc region is usually defined to include residues E216, C226, or A231 to its carboxyl-terminus, wherein the numbering is according to the EU index as in Kabat. In some embodiments, as is more fully described below, amino acid modifications are made to the Fc region, for example to alter binding to one or more FcγR or to the FcRn.

As will be appreciated by those in the art, the exact numbering and placement of the heavy constant region domains can be different among different numbering systems. A useful comparison of heavy constant region numbering according to EU and Kabat is as below, see Edelman et al., 1969, Proc Natl Acad Sci USA 63:78-85 and Kabat et al., 1991, Sequences of Proteins of Immunological Interest, 5th Ed., United States Public Health Service, National Institutes of Health, Bethesda, entirely incorporated by reference.

TABLE 1

|       | EU Numbering | Kabat Numbering |
|-------|--------------|-----------------|
| CH1   | 118-215      | 114-223         |
| Hinge | 216-230      | 226-243         |
| CH2   | 231-340      | 244-360         |
| CH3   | 341-447      | 361-478         |

A "variant Fc domain" contains amino acid modifications as compared to a parental Fc domain. Thus, a "variant human IgG1 Fc domain" is one that contains amino acid modifications (generally amino acid substitutions, although in the case of ablation variants, amino acid deletions are included) as compared to the human IgG1 Fc domain. In general, variant Fc domains have at least about 80, 85, 90, 95, 97, 98 or 99 percent identity to the corresponding parental human IgG Fc domain (using the identity algorithms discussed below, with one embodiment utilizing the BLAST algorithm as is known in the art, using default parameters). Alternatively, the variant Fc domains can have from 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Additionally, as discussed herein, the variant Fc domains herein still retain the ability to form a dimer with another Fc domain as measured using known techniques as described herein, such as non-denaturing gel electrophoresis.

By "heavy constant region" herein is meant the CH1-hinge-CH2-CH3 portion of an antibody (or fragments thereof), excluding the variable heavy domain; in EU numbering of human IgG1, such as amino acids 118-447. By "heavy chain constant region fragment" herein is meant a heavy chain constant region that contains fewer amino acids from either or both of the N- and C-termini but still retains the ability to form a dimer with another heavy chain constant region.

By "fusion protein" as used herein is meant covalent joining of at least two proteins. Fusion proteins may comprise artificial sequences, e.g. a domain linker, as described herein. By "Fc fusion protein" or "immunoadhesin" herein is meant a protein comprising an Fc region, generally linked (optionally through a domain linker, as described herein) to one or more different proteins, such as to IL-15 and/or IL-15R, as described herein. In some instances, two Fc fusion proteins can form a homodimeric Fc fusion protein or a heterodimeric Fc fusion protein with the latter being preferred. In some cases, one monomer of the heterodimeric Fc fusion protein comprises an Fc domain alone (e.g., an empty Fc domain) and the other monomer is a Fc fusion, comprising a variant Fc domain and a protein domain, such as a receptor, ligand or other binding partner.

By "position" as used herein is meant a location in the sequence of a protein. Positions may be numbered sequentially, or according to an established format, for example the EU index for antibody numbering.

By "strandedness" in the context of the monomers of the heterodimeric proteins of the invention herein is meant that, similar to the two strands of DNA that "match", heterodimerization variants are incorporated into each monomer so as to preserve, create, and/or enhance the ability to "match" to form heterodimers. For example, if some pI variants are engineered into monomer A (e.g., making the pI higher) then steric variants that are "charge pairs" that can be utilized as well do not interfere with the pI variants, e.g., the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer that incorporates one set of the pair will go, such that pI separation is maximized using the pI of the skews as well.

By "target antigen" as used herein is meant the molecule that is bound specifically by the variable region of a given antigen binding domain or antibody. A target antigen may be a protein, carbohydrate, lipid, or other chemical compound. A wide number of suitable target antigens are described below.

By "target cell" as used herein is meant a cell that expresses a target antigen.

By "host cell" in the context of producing a bispecific antibody according to the invention herein is meant a cell that contains the exogeneous nucleic acids encoding the components of the bispecific antibody and is capable of expressing the bispecific antibody under suitable conditions. Suitable host cells are discussed below.

By "variable region" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively.

By "wild type or WT" herein is meant an amino acid sequence or a nucleotide sequence that is found in nature, including allelic variations. A WT protein has an amino acid sequence or a nucleotide sequence that has not been intentionally modified.

"Percent (%) amino acid sequence identity" with respect to a protein sequence is defined as the percentage of amino acid residues in a candidate sequence that are identical with the amino acid residues in the specific (parental) sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. One particular program is the ALIGN-2 program outlined at paragraphs [0279] to [0280] of U.S. Pub. No. 20160244525, hereby incorporated by reference.

The invention provides a number of antigen binding domains that have sequence identity to human antibody domains. Sequence identity between two similar sequences (e.g., antibody variable domains) can be measured by algorithms such as that of Smith, T. F. & Waterman, M. S. (1981) "Comparison Of Biosequences," Adv. Appl. Math. 2:482 [local homology algorithm]; Needleman, S. B. & Wunsch, C D. (1970) "A General Method Applicable To The Search For Similarities In The Amino Acid Sequence Of Two Proteins," J. Mol. Biol. 48:443 [homology alignment algorithm], Pearson, W. R. & Lipman, D. J. (1988) "Improved Tools For Biological Sequence Comparison," Proc. Natl. Acad. Sci. (U.S.A.) 85:2444 [search for similarity method]; or Altschul, S. F. et al, (1990) "Basic Local Alignment Search Tool," J. Mol. Biol. 215:403-10, the "BLAST" algorithm, see https://blast.ncbi.nlm.nih.gov/Blast.cgi. When using any of the aforementioned algorithms, the default parameters (for Window length, gap penally, etc) are used. In one embodiment, sequence identity is done using the BLAST algorithm, using default parameter.

The degree of identity between an amino acid sequence of the present invention ("invention sequence") and the parental amino acid sequence is calculated as the number of exact matches in an alignment of the two sequences, divided by the length of the "invention sequence," or the length of the parental sequence, whichever is the shortest. The result is expressed in percent identity.

In some embodiments, two or more amino acid sequences are at least 50%, 60%, 70%, 80%, or 90% identical. In some embodiments, two or more amino acid sequences are at least 95%, 97%, 98%, 99%, or even 100% identical.

The heterodimeric Fc fusion proteins of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated heterodimeric Fc fusion protein," refers to a protein which is substantially free of other proteins from a cell culture such as host cell proteins. "Recombinant" means the antibodies are generated using recombinant nucleic acid techniques in exogeneous host cells, and they can be isolated as well By "antigen binding domain" or "ABD" herein is meant the part of an antigen binding molecule which confers its binding specificity to an antigenic determinant.

As used herein, the term "antigen binding molecule" refers in its broadest sense to any molecule that specifically binds to an antigenic determinant. An antigen binding molecule may be a protein, carbohydrate, lipid, or other chemical compound. Examples of antigen binding molecules are immunoglobulin and derivatives or fragments thereof, e.g., Fab and scFv. Additional examples of antigen binding molecules are receptors and ligands.

The strength, or affinity, of specific binding can be expressed in terms of dissociation constant (KD) of the interaction, wherein a smaller KD represents greater affinity and a larger KD represents lower affinity. Binding properties can be determined by methods well known in the art such as bio-layer interferometry and surface plasmon resonance based methods. One such method entails measuring the rates of antigen-binding site/antigen or receptor/ligand complex association and dissociation, wherein rates depend on the concentration of the complex partners, the affinity of the interaction, and geometric parameters that equally influence the rate in both directions. Thus, both the association rate (ka) and the dissociation rate (kd) can be determined, and the ratio of kd/ka is equal to the dissociation constant KD (See Nature 361:186-187 (1993) and Davies et al. (1990) Annual Rev Biochem 59:439-473).

Specific binding for a particular molecule or an epitope can be exhibited, for example, by an antigen binding molecule having a KD for an antigen or epitope of at least about $10^{-4}$ M, at least about $10^{-5}$M, at least about $10^{-6}$ M, at least about $10^{-7}$ M, at least about $10^{-8}$M, at least about $10^{-9}$M, alternatively at least about $10^{-10}$ M, at least about $10^{-11}$ M, at least about $10^{-12}$M, or greater. Typically, an antigen binding molecule that specifically binds an antigen will have a KD that is 20-, 50-, 100-, 500-, 1000-, 5,000-, 10,000- or more times greater for a control molecule relative to the antigen or epitope.

Also, specific binding for a particular molecule or an epitope can be exhibited, for example, by an antigen binding molecule having a ka or association rate for an antigen or epitope of at least 20-, 50-, 100-, 500-, 1000-, 5,000-, 10,000- or more times greater for the epitope relative to a control.

By "epitope" is herein meant a determinant that interacts with a specific antigen binding domain, for example variable region of an antibody molecule, known as a paratope. Epitopes are groupings of molecules such as amino acids or sugar side chains and usually have specific structural characteristics, as well as specific charge characteristics. A single molecule may have more than one epitope. The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide. Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents. An epitope typically includes at least 3, and more usually, at least 5 or 8-10 amino acids in a unique spatial conformation. Antigen binding molecules that recognize the same epitope can be verified in a simple immunoassay showing the ability of one antigen binding molecule to block the binding of another antigen binding molecule to a target antigen, for example "binning." As outlined below, the invention not only includes the enumerated antigen binding molecules and antigen binding domains herein, but those that compete for binding with the epitopes bound by the enumerated antigen binding molecules or antigen binding domains.

By "fused" or "covalently linked" is herein meant that the components (e.g., an IL-15 protein and an Fc domain) are linked by peptide bonds, either directly or via domain linkers, outlined herein.

As used herein, the term "single-chain" refers to a molecule comprising amino acid monomers linearly linked by peptide bonds. In certain embodiments, a single chain IL-15/IL-15Rα complex or "scIL-15/Rα", i.e. the IL-15 and the IL-15Rα sushi domain are fused to form a single peptide chain. In some embodiments, the C-terminus of IL-15 is connected to the N-terminus of the IL-15Rα sushi domain. In some embodiments, the monomers are linked directly. In other embodiments, the momoners are linked via domain linkers, outlined herein.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore SPR, or BLI assay.

Before the invention is further described, it is to be understood that this invention is not limited to particular embodiments described, and as such may, of course, vary. It is also to be understood that the terminology used herein is for the purpose of describing particular embodiments only, and is not intended to be limiting, since the scope of the present invention will be limited only by the appended claims.

IV. Targeted IL-15/IL-15Rα×Antigen Binding Domain Heterodimeric Fc Fusion Proteins Provided herein are heterodimeric fusion proteins that can bind to an antigen and can complex with the common gamma chain (γc; CD132) and the IL-2 receptor β-chain (IL-2Rβ; CD122). The heterodimeric fusion proteins can contain an IL-15/IL-15Rα-Fc fusion protein and an antigen binding domain. The IL-15/IL-15Rα-Fc fusion protein can include as IL-15 protein covalently attached to an IL-15Rα, and an Fc domain. Optionally, the IL-15 protein and IL-15Rα protein are noncovalently attached. The antigen binding domain specifically binds to a target antigen, such as, but not limited to, CD8, NKG2A, and NKG2D.

The Fc domains can be derived from IgG Fc domains, e.g., IgG1, IgG2, IgG3 or IgG4 Fc domains, with IgG1 Fc domains finding particular use in the invention. The following describes Fc domains that are useful for IL-15/IL-15Rα Fc fusion monomers and antigen binding domain of the bifunctional heterodimer proteins of the present invention.

The carboxy-terminal portion of each chain defines a constant region primarily responsible for effector function Kabat et al. collected numerous primary sequences of the variable regions of heavy chains and light chains. Based on the degree of conservation of the sequences, they classified individual primary sequences into the CDRs and the framework and made a list thereof (see SEQUENCES OF IMMUNOLOGICAL INTEREST, 5th edition, NIH publication, No. 91-3242, E. A. Kabat et al., entirely incorporated by reference). Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-215 according to the EU index as in Kabat. "Hinge" refers to positions 216-230 according to the EU index as in Kabat. "CH2" refers to positions 231-340 according to the EU index as in Kabat, and "CH3" refers to positions 341-447 according to the EU index as in Kabat. As shown in Table 1, the exact numbering and placement of the heavy chain domains can be different among different numbering systems. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second heavy chain constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (P230 in IgG1), wherein the numbering is according to the EU index as in Kabat. In some embodiments, for example in the context of an Fc region, the hinge is included, generally referring to positions 216-230. As noted herein, pI variants can be made in the hinge region as well.

Thus, the present invention provides different antibody domains, e.g, different Fc domains. As described herein and known in the art, the heterodimeric proteins of the invention comprise different domains, which can be overlapping as well. These domains include, but are not limited to, the Fc domain, the CH1 domain, the CH2 domain, the CH3 domain, the hinge domain, and the heavy constant domain (CH1-hinge-Fc domain or CH1-hinge-CH2-CH3).

Thus, the "Fc domain" includes the –CH2–CH3 domain, and optionally a hinge domain. In some embodiments, the Fc domain also includes a portion of the CH1 domain. In some of the embodiments herein, when a protein fragment, e.g., IL-15 or IL-15Rα is attached to an Fc domain, it is the C-terminus of the IL-15 or IL-15Rα construct that is attached to all or part of the hinge of the Fc domain; for example, it is generally attached to the sequence EPKS (SEQ ID NO: 7) which is the beginning of the hinge. In other embodiments, when a protein fragment, e.g., IL-15 or IL-15Rα, is attached to an Fc domain, it is the N-terminus of the IL-15 or IL-15Rα construct that is attached to the C-terminus of the CH3 domain of the Fc domain.

In some of the constructs and sequences outlined herein of an Fc domain protein, the C-terminus of the IL-15 or IL-15Rα protein fragment is attached to the N-terminus of a domain linker, the C-terminus of which is attached to the N-terminus of a constant Fc domain (N-IL-15 or IL-15Rα protein fragment-linker-Fc domain-C) although that can be switched (N-Fc domain-linker-IL-15 or IL-15Rα protein fragment-C). In other constructs and sequence outlined herein, C-terminus of a first protein fragment is attached to the N-terminus of a second protein fragment, optionally via a domain linker, the C-terminus of the second protein fragment is attached to the N-terminus of a constant Fc domain, optionally via a domain linker. In yet other constructs and sequences outlined herein, a constant Fc domain that is not attached to a first protein fragment or a second protein fragment is provided. A heterodimer Fc fusion protein can contain two or more of the exemplary monomeric Fc domain proteins described herein.

In some embodiments, the linker is a "domain linker", used to link any two domains as outlined herein together, some of which are depicted in FIG. 6. While any suitable linker can be used, many embodiments utilize a glycine-serine polymer, including for example (GS)n, (GSGGS)n (SEQ ID NO: 8), (GGGGS)n (SEQ ID NO: 9), and (GGGS)n (SEQ ID NO: 10), where n is an integer of at least one (and generally from 1 to 2 to 3 to 4 to 5) as well as any peptide sequence that allows for recombinant attachment of the two domains with sufficient length and flexibility to allow each domain to retain its biological function. In some cases, and with attention being paid to "strandedness", as outlined below, the linker is a charged domain linker. Accordingly, in some embodiments the present invention provides heterodimeric Fc fusion proteins that rely on the use of two different heavy chain variant Fc sequences, that will self-assemble to form a heterodimeric Fc domain fusion polypeptide.

In one embodiment, heterodimeric Fc fusion proteins contain at least two constant domains which can be engineered to produce heterodimers, such as pI engineering. Other Fc domains that can be used include fragments that contain one or more of the CH1, CH2, CH3, and hinge domains of the invention that have been pI engineered. In particular, the formats depicted in FIGS. 57A-57K are heterodimeric Fc fusion proteins, meaning that the protein has two associated Fc sequences self-assembled into a heterodimeric Fc domain and at least one protein fragment (e.g., 1, 2 or more protein fragments). In some cases, a first protein fragment is linked to a first Fc sequence and a second protein fragment is linked to a second Fc sequence. In some cases, the heterodimeric Fc fusion protein contains a first protein fragment linked to a second protein fragment which is linked to a first Fc sequence, and a second Fc sequence that is not linked to either the first or second protein fragments.

The present invention is directed to novel constructs to provide heterodimeric Fc fusion proteins that allow binding to one or more binding partners, ligands or receptors. The heterodimeric Fc fusion constructs are based on the self-assembling nature of the two Fc domains of the heavy chains of antibodies, e.g., two "monomers" that assemble into a "dimer". Heterodimeric Fc fusions are made by altering the amino acid sequence of each monomer as more fully discussed below. Thus, the present invention is generally directed to the creation of heterodimeric Fc fusion proteins which can co-engage binding partner(s) or ligand(s) or receptor(s) in several ways, relying on amino acid variants in the constant regions that are different on each chain to promote heterodimeric formation and/or allow for ease of purification of heterodimers over the homodimers.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes described herein as "skew" variants (see discussion in WO2014/145806), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric proteins; one relies on the use of pI variants, such that each monomer, and subsequently each dimeric species, has a different pI, thus allowing the isoelectric purification of A-A, A-B and B-B dimeric proteins. Alternatively, some formats also allow separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, that encourage heterodimerization formation over homodimerization formation, coupled with pI variants, which increase the pI difference between the two monomers and each dimeric species.

Additionally, as more fully outlined below, depending on the format of the heterodimer Fc fusion protein, pI variants can be either contained within the constant and/or Fc domains of a monomer, or domain linkers can be used. That is, the invention provides pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B can be changed, with the pI of monomer A increasing and the pI of monomer B decreasing. As discussed, the pI changes of either or both monomers can be done by removing or adding a charged residue (e.g., a neutral amino acid is replaced by a positively or negatively charged amino acid residue, e.g., glutamine to glutamic acid), changing a charged residue from positive or negative to the opposite charge (e.g. aspartic acid to lysine) or changing a charged residue to a neutral residue (e.g., loss of a charge; lysine to serine). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A:B+ or wt A:B−), or by increasing one region and decreasing the other region (A+:B− or A−:B+).

Thus, in general, a component of some embodiments of the present invention are amino acid variants in the constant regions that are directed to altering the isoelectric point (pI) of at least one, if not both, of the monomers of a dimeric protein by incorporating amino acid substitutions ("pI variants" or "pI substitutions") into one or both of the monomers. The separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components. That is, to determine which monomer to engineer or in which "direction" (e.g., more positive or more negative), the sequences of the Fc domains, and in some cases, the protein domain(s) linked to the Fc domain are calculated and a decision is made from there. As is known in the art, different Fc domains and/or protein domains will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some embodiments, heterodimers can be separated from homodimers on the basis of size. As shown in the Figures, for example, several of the formats allow separation of heterodimers and homodimers on the basis of size.

In the case where pI variants are used to achieve heterodimerization, by using the constant region(s) of Fc domains(s), a more modular approach to designing and purifying heterodimeric Fc fusion proteins is provided. Thus, in some embodiments, heterodimerization variants (including skew and purification heterodimerization variants) must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of Fc fusion proteins, as the ability to either eliminate, minimize and distinguish when homodimers are present is significant. Similarly, the ability to reliably test the reproducibility of the heterodimeric Fc fusion protein production is important.

A. Heterodimerization Variants

The present invention provides heterodimeric proteins, including heterodimeric Fc fusion proteins in a variety of formats, which utilize heterodimeric variants to allow for heterodimer formation and/or purification away from homodimers. The heterodimeric fusion constructs are based on the self-assembling nature of the two Fc domains, e.g., two "monomers" that assemble into a "dimer".

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

B. Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in in the FIG. 29 of U.S. Ser. No. 15/141,350, all of which is hereby incorporated by reference in its entirety, as well as in FIGS. 1A-1E.

One mechanism is generally referred to in the art as "knobs and holes", referring to amino acid engineering that creates steric influences to favor heterodimeric formation and disfavor homodimeric formation, as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A—monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g., these are "monomer corresponding sets) and C220E/P228E/368E paired with C220R/E224R/P228R/K409R.

Additional monomer A and monomer B variants can be combined with other variants, optionally and independently in any amount, such as pI variants outlined herein or other steric variants that are shown in FIG. 37 of U.S. 2012/0149876, all of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIGS. 1A-1E. Of particular use in many embodiments are the pairs of sets including, but not limited to, S364K/E357Q:L368D/K370S; L368D/K370S:S364K; L368E/K370S:S364K; T411T/K360E/Q362E:D401K; L368D/K370S:S364K/E357L; K370S:S364K/E357Q and T366S/L368A/Y407V:T366W (optionally including a bridging disulfide, T366S/L368A/Y407V/Y349C:T366W/S354C). In terms of nomenclature, the pair "S364K/E357Q:L368D/K370S" means that one of the monomers has the double variant set S364K/E357Q and the other has the double variant set L368D/K370S; as above, the "strandedness" of these pairs depends on the starting pI.

C. pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be used: one monomer may be wild type, or a variant that does not display a significantly different pI from wild-type, and the other can be either more basic or more acidic. Alternatively, each monomer may be changed, one to more basic and one to more acidic.

Preferred combinations of pI variants are shown in FIG. 30 of U.S. Ser. No. 15/141,350, all of which are herein incorporated by reference in its entirety. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, a preferred combination of pI variants has one monomer comprising 208D/295E/384D/418E/421D variants (N208D/Q295E/N384D/Q418E/N421D when relative to human IgG1) if one of the Fc monomers includes a CH1 domain. In some instances, the second monomer comprising a positively charged domain linker, including (GKPGS)$_4$ (SEQ ID NO: 31). In some cases, the first monomer includes a CH1 domain, including position 208. Accordingly, in constructs that do not include a CH1 domain (for example for heterodimeric Fc fusion proteins that do not utilize a CH1 domain on one of the domains), a preferred negative pI variant Fc set includes 295E/384D/418E/421D variants (Q295E/N384D/Q418E/N421D when relative to human IgG1).

In some embodiments, mutations are made in the hinge domain of the Fc domain, including positions 216, 217, 218, 219, 220, 221, 222, 223, 224, 225, 226, 227, 228, 229, and 230. Thus, pI mutations and particularly substitutions can be made in one or more of positions 216-230, with 1, 2, 3, 4 or 5 mutations finding use in the present invention. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 233, 234, 235, 236, 274, 296, 300, 309, 320, 322, 326, 327, 334 and 339. It should be noted that changes in 233-236 can be made to increase effector function (along with 327A) in the IgG2 backbone. Again, all possible combinations of these 14 positions can be made; e.g., a pI antibody may have 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non native threonine at position 339, and all possible combinations within CH2 and with other domains.

In this embodiment, the mutations can be independently and optionally selected from position 355, 359, 362, 384, 389, 392, 397, 418, 419, 444 and 447. Specific substitutions that find use in lowering the pI of CH3 domains include, but are not limited to, a non native glutamine or glutamic acid at position 355, a non-native serine at position 384, a non-native asparagine or glutamic acid at position 392, a non-native methionine at position 397, a non native glutamic acid at position 419, a non native glutamic acid at position 359, a non native glutamic acid at position 362, a non native glutamic acid at position 389, a non native glutamic acid at position 418, a non native glutamic acid at position 444, and a deletion or non-native aspartic acid at position 447. Exemplary embodiments of pI variants are provided in FIG. 2.

D. Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of U.S. Publ. App. No. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significantly affect the pI of the variant Fc fusion protein. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

E. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Publ. App. No. 2014/0370013. As discussed herein, which monomer to engineer is generally decided by the inherent pI of each monomer.

F pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall'Acqua et al. showed that Fc mutants with increased FcRn binding at pH 6 and pH 7.4 actually had reduced serum concentrations and the same half-life as wild-type Fc (Dail'Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

G. Additional Fc Variants for Additional Functionality

In addition to pI amino acid variants, there are a number of useful Fc amino acid modification that can be made for a variety of reasons, including, but not limited to, altering binding to one or more FcγR, altered binding to FcRn, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

H. FcγR Variants

Accordingly, there are a number of useful Fc substitutions that can be made to alter binding to one or more of the Fcγ receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, amino acid substitutions that increase affinity for FcγRIIc can also be included in the Fc domain variants outlined herein. The substitutions described in, for example, U.S. Ser. Nos. 11/124,620 and 14/578,305 are useful.

In addition, there are additional Fc substitutions that find use in increased binding to the FcRn and increased serum half-life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

I. Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more of all of the Fcγ receptors (e.g., FcγR1, FcγRIIa, FcγRIIb, FcγRIIIa, etc.) to avoid additional mechanisms of action. That is, for example, in many embodiments, particularly in the use of bifunctional immunomodulatory proteins, it is desirable to ablate FcγRIIIa binding to eliminate or significantly reduce ADCC activity such that one of the Fc domains comprises one or more Fcγ receptor ablation variants. These ablation variants are depicted in FIG. 31 of U.S. Ser. No. 15/141,350, all of which are herein incorporated by reference in its entirety, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to the EU index. It should be noted that the ablation variants referenced herein ablate FcγR binding but generally not FcRn binding.

J. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, may also be independently and optionally combined with Fc ablation variants, Fc variants, FcRn variants, as generally outlined herein.

In addition, a monomeric Fc domain can comprise a set of amino acid substitutions that includes C220S/S267K/L368D/K370S or C220S/S267K/S364K/E357Q.

In addition, the heterodimeric Fc fusion proteins can comprise skew variants (e.g., a set of amino acid substitutions as shown in FIGS. 1A-1C of U.S. Ser. No. 15/141,350, all of which are herein incorporated by reference in its entirety), with particularly useful skew variants being selected from the group consisting of S364K/E357Q: L368D/K370S; L368D/K370S:S364K; L368E/K370S: S364K; T411T/K360E/Q362E:D401K; L368D/K370S: S364K/E357L; K370S:S364K/E357Q; T366S/L368A/Y407V:T366W; and T366S/L368A/Y407V:T366W (optionally including a bridging disulfide, T366S/L368A/Y407V/Y349C:T366W/S354C), optionally ablation variants, optionally charged domain linkers; and optionally pI variants.

In some embodiments, the Fc domain comprises one or more amino acid substitutions selected from the group consisting of: 236R, S239D, S239E, F243L, M252Y, V259I, S267D, S267E, S67K, S298A, V308F, L328F, L328R, 330L, I332D, I332E, M428L, N434A, N434S, 236R/L328R, S239D/I332E, 236R/L328F, V259I/V308F, S267E/L328F, M428L/N43S, Y436I/M428L, N436V/M428L, V436I/N434S, Y436V/N434S, S239D/I332E/330L, M252Y/S54T/T256E, V259I/V308F/M428L, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K according to EU index.

In one embodiment, a particular combination of skew and pI variants that finds use in the present invention is T366S/L368A/Y407V:T366W (optionally including a bridging disulfide, T366S/L368A/Y407V/Y349C:T366W/S354C) with one monomer comprising Q295E/N384D/Q418E/N481D and the other a positively charged domain linker. As will be appreciated in the art, the "knobs in holes" variants do not change pI, and thus can be used on either monomer.

V. IL-15/IL-15Rα-Fc Fusion Monomers

The bifunctional heterodimeric fusion proteins of the present invention include an IL-15/IL-15 receptor alpha (IL-15Rα)-Fc fusion monomer. In some cases, the IL-15 and IL-15 receptor alpha (IL-15Rα) protein domains are in different orientations. Exemplary embodiments of IL-15/IL-15Rα-Fc fusion monomers are provided in the Figures including but not limited to FIGS. 4A-4E, 5A-5D, and 8A-8D.

In some embodiments, the human IL-15 protein has the amino acid sequence set forth in NCBI Ref. Seq. No. NP_000576.1 or SEQ ID NO:1. In some cases, the coding sequence of human IL-15 is set forth in NCBI Ref. Seq. No. NM_000585. An exemplary IL-15 protein of the Fc fusion heterodimeric protein outlined herein can have the amino acid sequence of SEQ ID NO:2 or amino acids 49-162 of SEQ ID NO:1. In some embodiments, the IL-15 protein has at least 90%, e.g., 90%, 91%, 92%, 93%, 94%, 95%, 96%, 97%, 98%, 99%, or more sequence identity to SEQ ID NO:2. In some embodiments, the IL-15 protein has the amino acid sequence set forth in SEQ ID NO:2 and the amino acid substitution N72D. In other embodiments, the IL-15 protein has the amino acid sequence of SEQ ID NO:2 and one or more amino acid substitutions selected from the group consisting of C42S, L45C, Q48C, V49C, L52C, E53C, E87C, and E89C. Optionally, the IL-15 protein also has an N72D substitution. The IL-15 protein of the Fc fusion protein can have 1, 2, 3, 4, 5, 6, 7, 8 or 9 amino acid substitutions. In some embodiments, the human IL-15 protein of the Fc fusion protein has the amino acid substitution N4D. In some embodiments, the human IL-15 protein of the Fc fusion protein has the amino acid substitution N65D. In some embodiments, the human IL-15 protein of the Fc fusion protein has amino acid substitutions N4D/N65D. In some embodiments, the human IL-15 protein of the Fc fusion protein has amino acid substitutions D30N/E64Q/N65D.

In some embodiments, the human IL-15 protein of the Fc fusion protein is identical to the amino acid sequence of SEQ ID NO:2. In some cases, the human IL-15 protein has no amino acid substitutions.

The amino acid substitution(s) may be isosteric substitutions at the IL-15:IL-2β and IL-15:common gamma chain interface. In some embodiments, the human IL-15 protein has one or more amino acid substitutions selected from the group consisting of N1D, N4D, D8N, D30N, D61N, E64Q, N65D, Q108E, and any combination thereof. In some embodiments, the IL-15 protein has the amino acid substitution Q108E. In some cases, the IL-15 protein has 1, 2, 3, 4, 5, 6, 7, 8, or more amino acid substitutions. The IL-15 protein can have a N1D, N4D, D8N, D30N, D61N, E64Q, N65D, or Q108E substitution. In some embodiments, the amino acid substitution can include N1D/D61N, N1D/E64Q, N4D/D61N, N4D/E64Q, D8N/D61N, D8N/E64Q, D61N/E64Q, E64Q/Q108E, N1D/N4D/D8N, D61N/E64Q/N65D, N1D/D61N/E64Q, N1D/D61N/E64Q/Q108E, or N4D/D61N/E64Q/Q108E. In some embodiments, the IL-15 protein has the amino acid substitution N4D. In certain embodiments, the IL-15 protein has the amino acid substitution N65D. In some embodiments, the IL-15 protein has the amino acid substitutions N4D/N65D. In some embodiments, the IL-15 protein has the amino acid substitutions D30N/E64Q/N65D.

In some embodiments, the human IL-15 receptor alpha (IL-15Rα) protein has the amino acid sequence set forth in NCBI Ref. Seq. No. NP_002180.1 or SEQ ID NO:3. In some cases, the coding sequence of human IL-15Rα is set forth in NCBI Ref. Seq. No. NM_002189.3. An exemplary the IL-15Rα protein of the Fc fusion heterodimeric protein outlined herein can comprise or consist of the sushi domain of SEQ ID NO:3 (e.g., amino acids 31-95 of SEQ ID NO:3), or in other words, the amino acid sequence of SEQ ID NO:4. In some embodiments, the IL-15Rα protein has the amino acid sequence of SEQ ID NO:4 and an amino acid insertion selected from the group consisting of D96, P97, A98, D96/P97, D96/C97, D96/P97/A98, D96/P97/C98, and D96/C97/A98, wherein the amino acid position is relative to full-length human IL-15Rα protein or SEQ ID NO:3. For instance, amino acid(s) such as D (e.g., Asp), P (e.g., Pro), A (e.g., Ala), DP (e.g., Asp-Pro), DC (e.g., Asp-Cys), DPA (e.g., Asp-Pro-Ala), DPC (e.g., Asp-Pro-Cys), or DCA (e.g., Asp-Cys-Ala) can be added to the C-terminus of the IL-15Rα protein of SEQ ID NO:4. In some embodiments, the IL-15Rα protein has the amino acid sequence of SEQ ID NO:4 and one or more amino acid substitutions selected from the group consisting of K34C, A37C, G38C, S40C, and L42C, wherein the amino acid position is relative to SEQ ID NO:4. The IL-15Rα protein can have 1, 2, 3, 4, 5, 6, 7, 8 or more amino acid mutations (e.g., substitutions, insertions and/or deletions).

SEQ ID NO: 1 is
MRISKPHLRSISIQCYLCLLLNSHFLTEAGIHVFILGCFSAGLPKTEANW

VNVISDLKKIEDLIQSMHIDATLYTESDVHPSCKVTAMKCFLLELQVISL

ESGDASIHDTVENLIILANNSLSSNGNVTESGCKECEELEEKNIKEFLQS

FVHIVQMFINTS.

SEQ ID NO: 2 is
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS.

SEQ ID NO: 3 is
MAPRRARGCRTLGLPALLLLLLLRPPATRGITCPPPMSVEHADIWVKSYS

LYSRERYICNSGFKRKAGTSSLTECVLNKATNVAHWTTPSLKCIRDPALV

HQRPAPPSTVTTAGVTPQPESLSPSGKEPAASSPSSNNTAATTAAIVPGS

QLMPSKSPSTGTTEISSHESSHGTPSQTTAKNWELTASASHQPPGVYPQG

HSDTTVAISTSTVLLCGLSAVSLLACYLKSRQTPPLASVEMEAMEALPVT

WGTSSRDEDLENCSHHL.

SEQ ID NO: 4 is
ITCPPPMSVEHADIWVKSYSLYSRERYICNSGFKRKAGTSSLTECVLNKA

TNVAHWTTPSLKCIR.

In some embodiments, an IL-15 protein is attached to the N-terminus of an Fc domain, and an IL-15Rα protein is attached to the N-terminus of the IL-15 protein. In other embodiments, an IL-15Rα protein is attached to the N-terminus of an Fc domain and the IL-15Rα protein is noncovalently attached to an IL-15 protein. In yet other embodiments, an IL-15Rα protein is attached to the C-terminus of an Fc domain and the IL-15Rα protein is non-covalently attached to an IL-15 protein.

In some embodiments, the IL-15 protein and IL-15Rα protein are attached together via a linker. Optionally, the proteins are not attached via a linker. In other embodiments, the IL-15 protein and IL-15Rα protein are noncovalently attached. In some embodiments, the IL-15 protein is attached to an Fc domain via a linker. In other embodiments, the IL-15Rα protein is attached to an Fc domain via a linker. Optionally, a linker is not used to attach the IL-15 protein or IL-15Rα protein to the Fc domain.

In some instances, the immune checkpoint ABD is covalently attached to the N-terminus of an Fc domain via a linker, such as a domain linker.

In some embodiments, the linker is a "domain linker", used to link any two domains as outlined herein together. While any suitable linker can be used, many embodiments utilize a glycine-serine polymer, including for example (GS)n, (GSGGS)n (SEQ ID NO: 8), (GGGGS)n (SEQ ID NO: 9), and (GGGS)n (SEQ ID NO: 10), where n is an integer of at least 1 (and generally from 1 to 2 to 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers can be used as discussed herein and shown in FIGS. 6 and 7.

VI. Antigen Binding Domain Monomers

Therapeutic strategies focused on CD8$^+$ T cell proliferation and activation may provide great promise in the clinic for the treatment of cancer. Cancer can be considered as an inability of the patient to recognize and eliminate cancerous cells. In many instances, these transformed (e.g., cancerous) cells counteract immunosurveillance. There are natural control mechanisms that limit T-cell activation in the body to prevent unrestrained T-cell activity, which can be exploited by cancerous cells to evade or suppress the immune response. Restoring the capacity of immune effector cells—especially T cells—to recognize and eliminate cancer is the goal of immunotherapy. The field of immuno-oncology, sometimes referred to as "immunotherapy" is rapidly evolving, with several recent approvals of T cell checkpoint inhibitory antibodies such as Yervoy®, Keytruda® and Opdivo®. It is generally understood that a variety of immunomodulatory signals, both costimulatory and coinhibitory, can be used to orchestrate an optimal antigen-specific immune response.

The present invention relates to the generation of bifunctional heterodimeric proteins that bind to immune cells such as CD8+ T cells or NK cells and/or cells expressing IL-2Rβ and the common gamma chain (γc; CD132). The bifunctional heterodimeric protein can include an antigen binding monomer of any useful antibody format that can bind to an immune antigen or immune cell. In some embodiments, the antigen binding monomer includes a Fab or a scFv linked to an Fc domain.

Exemplary embodiments of such an antigen binding monomer are provided in FIG. 66A (chains 2 and 3 of XENP24114), FIG. 66A (chains 2 and 3 of XENP24115), FIG. 66B (chains 2 and 3 of XENP24116), FIG. 60A (chains 2 and 3 of XENP24532), FIG. 61A (chains 2 and 3 of XENP24533), FIG. 61A (chains 2 and 3 of XENP24534), FIG. 79A (chains 2 and 3 of XENP24543), FIG. 79A (chains 2 and 3 of XENP24546), FIG. 79B (chains 2 and 3 of XENP24547), and FIG. 79B (chains 2 and 3 of XENP24548).

A. Target Antigens

The targeted heterodimeric proteins of the present invention have at least one antigen binding domain (ABD) that binds to a target antigen fused to an Fc domain, and an IL-15/IL-15Rα protein domain fused in a different Fc domain. Suitable target antigens include human (and sometimes cyno) CD8, NKG2A, and NKG2B. In some embodiments, two different ABDs that bind to two different target antigens ("target pairs") are present, in either bivalent, bifunctional formats or trivalent, bifunctional formats. Accordingly, suitable bifunctional ABDs bind CD8 and NKG2A, CD8 and NKG2D, or NKG2A and NKG2D. In yet other embodiments, the bifunctional heterodimeric proteins have two different antigen binding domains (ABDs) that bind to the same target antigens ("target pairs"), in either bivalent, bifunctional formats or trivalent, bifunctional formats, and an IL-15/IL-15Rα protein domain fused to one of the Fc domains of the protein.

The ABD can be in a variety of formats, such as in a Fab format or in an scFv format. Exemplary ABDs for use in the present invention are disclosed in U.S. 62/353,511, the contents are hereby incorporated in its entirety for all purposes.

In some embodiments, one of the ABDs binds CD8. Suitable ABDs that bind CD8 are shown in FIGS. 65A-65F as bivalent antibodies (XENP15076 and XENP15251); Fab (XENP23647); one-armed Fab-Fc antibody (XENP24317); FIG. 81 as bivalent antibody (XENP24025); one-armed Fab-Fc antibody (XENP24321); FIG. 89 (as murine and humanized variable heavy and variable light domains); FIG. 90 as a bivalent antibody (XENP15075); FIG. 91 as a one-armed Fab-Fc antibody (XENP24920); and FIG. 95 (as variant humanized variable heavy and variable light domains. As will be appreciated by those in the art, suitable ABDs can comprise a set of 6 CDRs as depicted in these Figures, as they are underlined. In some embodiments, the monomer containing an ABD that binds CD8 can act as a non-blocking anti-CD8 arm.

In some embodiments, one of the ABDs binds NKG2A. Suitable ABDs that bind NKG2A are shown in FIG. 58 as a bivalent antibody (XENP24541 and XENP24542) and Fab (XENP24542). As will be appreciated by those in the art, suitable ABDs can comprise a set of 6 CDRs as depicted in these Figures, as they are underlined.

In some embodiments, one of the ABDs binds NKG2D. Suitable ABDs that bind NKG2D are shown in FIG. 59 (XENP24365). As will be appreciated by those in the art, suitable ABDs can comprise a set of 6 CDRs as depicted in this Figure, as they are underlined.

In addition, the antibodies of the invention include those that bind to either the same epitope as the antigen binding domains outlined herein, or compete for binding with the antigen binding domains outlined herein. In some embodiments, the bifunctional checkpoint antibody can contain one of the ABDs outlined herein and a second ABD that competes for binding with one of the ABDs outlined herein. In some embodiments both ABDs compete for binding with the corresponding ABD outlined herein. Binding competition is generally determined using Biacore assays as outlined herein.

As will be appreciated by those in the art and discussed more fully below, the heterodimeric fusion proteins of the present invention can take on a wide variety of configurations, as are generally depicted in FIG. 1 of U.S. 62/353,511. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. See, FIGS. 57A-57K. Thus, the present invention is directed to novel immunoglobulin compositions that co-engage an immune antigen and an IL-15/IL-15Rα binding partner.

As will be appreciated by those in the art, the heterodimeric formats of the invention can have different valencies as well as be bifunctional. That is, heterodimeric antibodies of the invention can be bivalent and bifunctional, wherein one target antigen is bound by one binding domain and the other target antigen is bound by a second binding domain. The heterodimeric antibodies can also be trivalent and bifunctional, wherein the first antigen is bound by two binding domains and the second antigen by a second binding domain.

B. Antibodies

As is discussed below, the term "antibody" is used generally. Antibodies that find use in the present invention can take on a number of formats as described herein, including traditional antibodies as well as antibody derivatives, fragments and mimetics, described herein and depicted in the figures. In some embodiments, the present invention provides antibody fusion proteins containing an antigen binding domain and an Fc domain. In some embodiments, the antibody fusion protein forms a bifunctional heterodimeric protein with an IL-15/IL-15Rα Fc fusion protein described herein. Exemplary embodiments of such bifunctional heterodimeric proteins include, but are not limited to, XENP24114, XENP24115, XENP24116, XENP24531, XENP24532, XENP24533, XENP24534, XENP24543, XENP24546, XENP24547,and XENP24548. Exemplary formats of such bifunctional heterodimeric proteins include, but are not limited to, those depicted in FIGS. 57A-57K.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to antibodies or antibody fragments (antibody monomers) that generally are based on the IgG class, which has several subclasses, including, but not limited to IgG1, IgG2, IgG3, and IgG4. In general, IgG1, IgG2 and IgG4 are used more frequently than IgG3. It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype.

In addition, many of the sequences herein have at least one the cysteines at position 220 replaced by a serine; generally this is the on the "scFv monomer" side for most of the sequences depicted herein, although it can also be on the "Fab monomer" side, or both, to reduce disulfide formation. Specifically included within the sequences herein are one or both of these cysteines replaced (C220S).

Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in U.S. Publ. Appl. No. 2009/0163699, incorporated by reference, the present invention covers pI engineering of IgG1/G2 hybrids.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vhCDRs (e.g. vlCDR1, vlCDR2 and vlCDR3). A useful comparison of CDR numbering is as below, see Lafranc et al., Dev. Comp. Immunol. 27(1):55-77 (2003).

TABLE 2

|        | Kabat + Chothia | IMGT    | Kabat  | AbM    | Chothia | Contact | Xencor  |
|--------|-----------------|---------|--------|--------|---------|---------|---------|
| vhCDR1 | 26-35           | 27-38   | 31-35  | 26-35  | 26-32   | 30-35   | 27-35   |
| vhCDR2 | 50-65           | 56-65   | 50-65  | 50-58  | 52-56   | 47-58   | 54-61   |
| vhCDR3 | 95-102          | 105-117 | 95-102 | 95-102 | 95-102  | 93-101  | 103-116 |
| vlCDR1 | 24-34           | 27-38   | 24-34  | 24-34  | 24-34   | 30-36   | 27-38   |
| vlCDR2 | 50-56           | 56-65   | 50-56  | 50-56  | 50-56   | 46-55   | 56-62   |
| vlCDR3 | 89-97           | 105-117 | 89-97  | 89-97  | 89-97   | 89-96   | 97-105  |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g, Kabat et al., supra (1991)).

Another type of Ig domain of the heavy chain is the hinge region. By "hinge" or "hinge region" or "antibody hinge region" or "hinge domain" herein is meant the flexible polypeptide comprising the amino acids between the first and second constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (P230 in IgG1), wherein the numbering is according to the EU index as in Kabat. In some cases, a "hinge fragment" is used, which contains fewer amino acids at either or both of the N- and C-termini of the hinge domain. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or Cκ).

Another region of interest for additional substitutions, outlined above, is the Fc region.

The present invention provides a large number of different CDR sets. In this case, a "full CDR set" comprises the three variable light and three variable heavy CDRs, e.g., a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

Thus, the present invention provides different antibody domains. As described herein and known in the art, the heterodimeric antibodies of the invention comprise different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

Thus, the "Fc domain" includes the –CH2-CH3 domain, and optionally a hinge domain (–H—CH2-CH3). In the embodiments herein, when a scFv is attached to an Fc domain, it is the C-terminus of the scFv construct that is attached to all or part of the hinge of the Fc domain; for example, it is generally attached to the sequence EPKS (SEQ ID NO: 7) which is the beginning of the hinge. The heavy chain comprises a variable heavy domain and a constant domain, which includes a CH1-optional hinge-Fc domain comprising a CH2-CH3. The light chain comprises a variable light chain and the light constant domain. A scFv comprises a variable heavy chain, an scFv linker, and a variable light domain. In most of the constructs and sequences outlined herein, the C-terminus of the variable heavy chain is attached to the N-terminus of the scFv linker, the C-terminus of which is attached to the N-terminus of a variable light chain (N-vh-linker-vl-C) although that can be switched (N-vl-linker-vh-C).

Some embodiments of the invention comprise at least one scFv domain, which, while not naturally occurring, generally includes a variable heavy domain and a variable light domain, linked together by a scFv linker. As outlined herein, while the scFv domain is generally from N- to C-terminus oriented as vh-scFv linker-vl, this can be reversed for any of the scFv domains (or those constructed using vh and vl sequences from Fabs), to vl-scFv linker-vh, with optional linkers at one or both ends depending on the format (see generally FIGS. 57A-57K.

As shown herein, there are a number of suitable linkers (for use as either domain linkers or scFv linkers) that can be used to covalently attach the recited domains, including traditional peptide bonds, generated by recombinant techniques. In some embodiments, the linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n (SEQ ID NO: 8), (GGGGS)n (SEQ ID NO: 9), and (GGGS)n (SEQ ID NO: 10), where n is an integer of at least one (and generally from 3 to 4), glycine-alanine polymers, alanine-serine polymers, and other flexible linkers. Illustrative domain linkers are depicted in FIG. 6. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers.

Other linker sequences may include any sequence of any length of CL/CH1 domain but not all residues of CL/CH1 domain; for example, the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g., TCR, FcR, KIR), hinge region-derived sequences, and other natural sequences from other proteins.

In some embodiments, the linker is a "domain linker", used to link any two domains as outlined herein together. For example, there may be a domain linker that attaches the C-terminus of the CH1 domain of the Fab to the N-terminus of the scFv, with another optional domain linker attaching the C-terminus of the scFv to the CH2 domain (although in many embodiments the hinge is used as this domain linker). While any suitable linker can be used, many embodiments utilize a glycine-serine polymer as the domain linker, including for example (GS)n, (GSGGS)n (SEQ ID NO: 8), (GGGGS)n (SEQ ID NO: 9), and (GGGS)n (SEQ ID NO: 10), where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used.

In some embodiments, the linker is a scFv linker, used to covalently attach the vh and vl domains as discussed herein. Accordingly, the present invention further provides charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make triple F format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well can be used in any embodiment herein where a linker is utilized. In particular, the formats depicted in FIGS. 57A-57K comprise antigen binding proteins, usually referred to as "heterodimeric Fc fusion proteins", meaning that the protein has at least two associated Fc sequences self-assembled into a heterodimeric Fc domain and at least one or more Fv regions, whether as Fabs or as scFvs.

C. Chimeric and Humanized Antibodies

In some embodiments, the antibodies herein can be derived from a mixture from different species, e.g., a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321: 522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. Nos. 5,530,101; 5,585,089; 5,693,761; 5,693,762; 6,180,370; 5,859,205; 5,821,337; 6,054,297; 6,407,213, all entirely incorporated by reference). The humanized antibody optimally also will comprise at least a portion of an immunoglobulin constant region, typically that of a human immunoglobulin, and thus will typically comprise a human Fc region Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference. In certain embodiments, the antibodies of the invention comprise a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody. A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants of the invention). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants of the invention). In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

VII. Useful Embodiments of the Invention

As shown in FIGS. 57A-57K, there are a number of useful formats of the bispecific heterodimeric fusion proteins of the invention. In general, the heterodimeric fusion proteins of the invention have three functional components: an IL-15/IL-15Rα(sushi) component, an antigen binding domain component (e.g. an anti-CD8 component, an anti-NKG2A component, and an anti-NKG2D component), and an Fc component, each of which can take different forms as outlined herein and each of which can be combined with the other components in any configuration.

The first and the second Fc domains can have a set of amino acid substitutions selected from the group consisting of a) S267K/L368D/K370S:S267K/S364K/E357Q; b) S364K/E357Q:L368D/K370S; c) L368D/K370S:S364K; d) L368E/K370S:S364K; e) T411T/K360E/Q362E:D401K; f) L368D/K370S:S364K/E357L and g) K370S:S364K/E357Q, according to EU numbering.

In some embodiments, the first and/or the second Fc domains have an additional set of amino acid substitutions comprising Q295E/N384D/Q418E/N421D, according to EU numbering.

Optionally, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

Optionally, the first and/or second Fc domains have 428L/434S variants for half life extension.

scIL-15/RαxscFv

One embodiment is shown in FIG. 57A, and comprises two monomers. The first monomer comprises, from N- to C-terminus, the sushi domain-domain linker-IL-15-domain linker-CH2-CH3, and the second monomer comprises vh-scFv linker-vl-hinge-CH2-CH3 or vl-scFv linker-vh-hinge-CH2-CH3, although in either orientation a domain linker can be substituted for the hinge. This is generally referred to as "scIL-15/RαxscFv", with the "sc" standing for "single chain" referring to the attachment of the IL-15 and sushi domain using a covalent linker.

Referring to FIG. 57A, the scIL-15/RαxscFv format comprises IL-15Rα(sushi) fused to IL-15 by a variable length linker (termed "scIL-15/Rα") which is then fused to the N-terminus of a heterodimeric Fc-region, with an scFv fused to the other side of the heterodimeric Fc. An illustrative embodiment of such a heterodimeric protein can be XENP25137.

In the scIL-15/RαxscFv format, one preferred embodiment utilizes the skew variant pair S364K/E357Q:L368D/K370S In the scIL-15/RαxscFv format, one preferred embodiment utilizes the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236/S267K on both monomers, and optionally the 428L/434S variants on both sides.

In the scIL-15/RαxscFv format, one preferred embodiment utilizes an anti-CD8 ABD and has the sequence of human_IL15Rα(Sushi)_Fc(216)_IgG1_pI(−) Isosteric_A_C220S/PVA_/S267K/L368D/K370 S IL-15Rα(sushi)-Fc chain (chain 1), IL15 D30N/E64Q/N65D (chain 2), OKT8[CD8]_H2_IgG1_PVA_/S267K/S364K/E357Q heavy chain (chain 3), and OKT8[CD8]_L1 light chain (chain 4), as shown in FIG. 92C.

One preferred embodiment utilizes a scIL-15/Rα complex having a sequence of human_IL15Rα(Sushi)_Fc(216)_IgG1_pI(−) Isosteric_A_C220S/PVA_/S267K/L368D/K370S IL-15Rα(sushi)-Fc chain (single chain), as shown in FIG. 92C.

In some embodiments, the heterodimeric protein comprises: a first monomer comprising, from N- to C-terminal: i) an IL-15 sushi domain; ii) a first domain linker; iii) a variant IL-15 domain; iv) a second domain linker; v) a first variant Fc domain comprising CH2-CH3; and b) a second monomer comprising, from N- to C-terminal: i) a scFv domain; ii) a third domain linker; iii) a second variant Fc domain comprising CH2-CH3; wherein the scFv domain comprises a first variable heavy domain, an scFv linker and a first variable light domain, and the scFv domain binds human CD8, NKG2A, or NKG2D.

scFvxncIL-15/Rα

This embodiment is shown in FIG. 57B, and comprises three monomers. The first monomer comprises, from N- to C-terminus, the sushi domain-domain linker-CH2-CH3, and the second monomer comprises vh-scFv linker-vl-hinge-CH2-CH3 or vl-scFv linker-vh-hinge-CH2-CH3, although in either orientation a domain linker can be substituted for the hinge. The third monomer is the IL-15 domain. This is generally referred to as "ncIL-15/RαxscFv" or "scFvxncIL-15/Rα" with the "nc" standing for "non-covalent" referring to the self-assembling non-covalent attachment of the IL-15 and sushi domain.

Referring to FIG. 57B, the scFvxncIL-15/Rα format comprises an scFv fused to the N-terminus of a heterodimeric Fc-region, with IL-15Rα(sushi) fused to the other side of the heterodimeric Fc, while IL-15 is transfected separately so that a non-covalent IL-15/Rα complex is formed.

In the ncIL-15/RαxscFv format, one preferred embodiment utilizes the skew variant pair S364K/E357Q:L368D/K370S.

In the ncIL-15/RαxscFv format, one preferred embodiment utilizes the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236/S267K on both monomers, and optionally the 428L/434S variants on both sides.

In some embodiments, the heterodimeric protein comprises: a first monomer comprising, from N- to C-terminus: i) an IL-15 sushi domain; ii) a first domain linker; iii) a first variant Fc domain comprising CH2-CH3; b) a second monomer comprising, from N- to C-terminus: i) a scFv domain; ii) a second domain linker; iii) a second variant Fc domain comprising CH2-CH3; wherein said scFv domain comprises a first variable heavy domain, an scFv linker and a first variable light domain; and c) a third monomer comprising a variant IL-15 domain, wherein said scFv domain binds human CD8, NKG2A, or NKG2D.

scFvxdsIL-15/Rα

This embodiment is shown in FIG. 57C, and comprises three monomers. The first monomer comprises, from N- to C-terminus, the sushi domain-domain linker-CH2-CH3, wherein the sushi domain has an engineered cysteine residue and the second monomer comprises vh-scFv linker-vl-hinge-CH2-CH3 or vl-scFv linker-vh-hinge-CH2-CH3, although in either orientation a domain linker can be substituted for the hinge. The third monomer is the IL-15 domain, also engineered to have a cysteine variant amino acid, thus allowing a disulfide bridge to form between the sushi domain and the IL-15 domain. This is generally referred to as "scFvxdsIL-15/Rα" or dsIL-15/RαxscFv, with the "ds" standing for "disulfide".

Referring to FIG. 57C, the scFvxdsIL-15/Rα format comprises an scFv fused to the N-terminus of a heterodimeric Fc-region, with IL-15Rα(sushi) fused to the other side of the heterodimeric Fc, while IL-15 is transfected separately so that a covalent IL-15/Rα complex is formed as a result of engineered cysteines.

In the scFvxdsIL-15/Rα format, one preferred embodiment utilizes the skew variant pair S364K/E357Q:L368D/K370S.

In the scFvxdsIL-15/Rα format, one preferred embodiment utilizes the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236/S267K on both monomers, and optionally the 428L/434S variants on both sides.

In some embodiments, the heterodimeric protein comprises: a) a first monomer comprising, from N- to C-terminus: i) a variant IL-15 sushi domain with a cysteine residue; ii) a first domain linker; iii) a first variant Fc domain comprising CH2-CH3; b) a second monomer comprising, from N- to C-terminus: i) a scFv domain; ii) a second domain linker; iii) a second variant Fc domain comprising CH2-CH3; wherein the scFv domain comprises a first variable heavy domain, an scFv linker and a first variable light domain; and c) a third monomer comprising a variant IL-15 domain comprising a cysteine residue; wherein the variant IL-15 sushi domain and the variant IL-15 domain form a disulfide bond and the scFv domain binds human CD8, NKG2A, or NKG2D.

scIL-15/RαxFab

This embodiment is shown in FIG. 57D, and comprises three monomers. The first monomer comprises, from N- to C-terminus, the sushi domain-domain linker-IL-15-domain linker-CH2-CH3 and the second monomer comprises a heavy chain, VH-CH1-hinge-CH2-CH3. The third monomer is a light chain, VL-CL. This is generally referred to as "scIL-15/RαxFab", with the "sc" standing for "single chain". Preferred combinations of variants for this embodiment are found in FIGS. 60A, 60B, 61A, 61B, 66A, 66B, 87, 92A, 92B, 92C, 97A, 97B, and 102.

Referring to FIG. 57D, the scIL-15/RαxFab (or FabxscIL-15/Rα) format comprises IL-15Rα(sushi) fused to IL-15 by a variable length linker (termed "scIL-15/Rα") which is then fused to the N-terminus of a heterodimeric Fc-region, with a variable heavy chain (VH) fused to the other side of the heterodimeric Fc, while a corresponding light chain is transfected separately so as to form a Fab with the VH. Illustrative embodiments of such heterodimeric proteins can be XENP24114, XENP24115, XENP24116, XENP24736, XENP24917, XENP, 24918, XENP24919, XENP25137, XENP26223, XENP26224, XENP26227, XENP26229, XENP26585, XENP24531, XENP24532, XENP24533, XENP24534, XENP27145, XENP27145, and XENP27146.

In the scIL-15/RαxFab format, one preferred embodiment utilizes the anti-CD8 ABD having the sequence depicted in FIG. 102. In some embodiments, the I1-15 complex of the scIL-15/RαxFab utilizes the sequence depicted in FIG. 102. In some cases, the heterodimeric protein is XENP26585.

In some embodiments, the scIL-15/Rαxanti-CD8 heterodimeric protein utilizes the anti-CD8 ABD having the sequence depicted in FIG. 97A. In some embodiments, the IL-15 complex of protein utilizes the sequence depicted in FIG. 97A. In some cases, the heterodimeric protein is XENP26223.

In other embodiments, the scIL-15/Rαxanti-CD8 heterodimeric protein utilizes the anti-CD8 ABD having the sequence depicted in FIG. 97A. In some embodiments, the IL-15 complex of protein utilizes the sequence depicted in FIG. 97A. In some cases, the heterodimeric protein is XENP26224.

In various embodiments, the scIL-15/Rαxanti-CD8 heterodimeric protein utilizes the anti-CD8 ABD having the sequence depicted in FIG. 97B. In some embodiments, the IL-15 complex of protein utilizes the sequence depicted in FIG. 97B. In some cases, the heterodimeric protein is XENP26227.

In certain embodiments, the scIL-15/Rαxanti-CD8 heterodimeric protein utilizes the anti-CD8 ABD having the sequence depicted in FIG. 97B. In some embodiments, the IL-15 complex of protein utilizes the sequence depicted in FIG. 97B. In some cases, the heterodimeric protein is XENP26229.

In some embodiments, the scIL-15/Rαxanti-CD8 heterodimeric protein utilizes the anti-CD8 ABD having the sequence depicted in FIG. 92A. In some embodiments, the IL-15 complex of protein utilizes the sequence depicted in FIG. 92A. In some cases, the heterodimeric protein is XENP24917.

In other embodiments, the scIL-15/Rαxanti-CD8 heterodimeric protein utilizes the anti-CD8 ABD having the sequence depicted in FIG. 92B. In some embodiments, the IL-15 complex of protein utilizes the sequence depicted in FIG. 92B. In some cases, the heterodimeric protein is XENP24918.

In some embodiments, the scIL-15/Rα×anti-CD8 heterodimeric protein utilizes the anti-CD8 ABD having the sequence depicted in FIG. 92B. In some embodiments, the IL-15 complex of protein utilizes the sequence depicted in FIG. 92B. In some cases, the heterodimeric protein is XENP24919.

In one embodiment, the scIL-15/Rα×anti-CD8 heterodimeric protein utilizes the anti-CD8 ABD having the sequence depicted in FIG. 87. In some embodiments, the IL-15 complex of protein utilizes the sequence depicted in FIG. 87. In some cases, the heterodimeric protein is XENP24736.

In another embodiment, the scIL-15/Rα×anti-CD8 heterodimeric protein utilizes the anti-CD8 ABD having the sequence depicted in FIG. 66A. In some embodiments, the IL-15 complex of protein utilizes the sequence depicted in FIG. 66A. In some cases, the heterodimeric protein is XENP24114.

In yet another embodiment, the scIL-15/Rα×anti-CD8 heterodimeric protein utilizes the anti-CD8 ABD having the sequence depicted in FIG. 66A. In some embodiments, the IL-15 complex of protein utilizes the sequence depicted in FIG. 66A. In some cases, the heterodimeric protein is XENP24115.

In another embodiment, the scIL-15/Rα×anti-CD8 heterodimeric protein utilizes the anti-CD8 ABD having the sequence depicted in FIG. 66A. In some embodiments, the IL-15 complex of protein utilizes the sequence depicted in FIG. 66A. In some cases, the heterodimeric protein is XENP24116.

In the scIL-15/Rα×Fab format, one preferred embodiment utilizes the anti-NKG2D ABD having the sequence depicted in FIG. 61A. In some embodiments, the I1-15 complex of the scIL-15/Rα×Fab utilizes the sequence depicted in FIG. 61A. In some cases, the heterodimeric protein is XENP24533.

In the scIL-15/Rα×Fab format, one preferred embodiment utilizes the anti-NKG2D ABD having the sequence depicted in FIG. 61A. In some embodiments, the I1-15 complex of the scIL-15/Rα×Fab utilizes the sequence depicted in FIG. 61A. In some cases, the heterodimeric protein is XENP24534.

In the scIL-15/Rα×Fab format, one preferred embodiment utilizes the anti-NKG2D ABD having the sequence depicted in FIG. 61B. In some embodiments, the I1-15 complex of the scIL-15/Rα×Fab utilizes the sequence depicted in FIG. 61B. In some cases, the heterodimeric protein is XENP24535.

In the scIL-15/Rα×Fab format, one preferred embodiment utilizes the anti-NKG2A ABD having the sequence depicted in FIG. 60A. In some embodiments, the I1-15 complex of the scIL-15/Rα×Fab utilizes the sequence depicted in FIG. 60A. In some cases, the heterodimeric protein is XENP24531.

In the scIL-15/Rα×Fab format, one preferred embodiment utilizes the anti-NKG2A ABD having the sequence depicted in FIG. 60A. In some embodiments, the I1-15 complex of the scIL-15/Rα×Fab utilizes the sequence depicted in FIG. 60A. In some cases, the heterodimeric protein is XENP24532.

In another embodiment, the heterodimeric protein utilizes the anti-NKG2A ABD having the sequence depicted in FIG. 60B. In some embodiments, the I1-15 complex of the scIL-15/Rα×Fab utilizes the sequence depicted in FIG. 60B. In some cases, the heterodimeric protein is XENP27146.

In the scIL-15/Rα×Fab format, one preferred embodiment utilizes the skew variant pair S364K/E357Q:L368D/K370S.

In the scIL-15/Rα×Fab format, one preferred embodiment utilizes the skew variants S364K/E357Q (on the anti-CD8 monomer, the anti-NKG2A monomer, or the anti-NKG2D monomer) and L368D/K370S (on the IL-15 complex monomer), the pI variants Q295E/N384D/Q418E/N421D (on the IL-15 complex side), the ablation variants E233P/L234V/L235A/G236/S267K on both monomers, and optionally the 428L/434S variants on both sides.

In some embodiments, the heterodimeric protein comprises: a) a first monomer comprising, from N- to C-terminus: i) an IL-15 sushi domain; ii) a first domain linker; iii) a variant IL-15 domain; iv) a second domain linker; v) a first variant Fc domain comprising CH2-CH3; and b) a second monomer comprising a heavy chain comprising VH-CH1-hinge-CH2-CH3, wherein the CH2-CH3 is a second variant Fc domain; and c) a light chain comprising VL-CL; wherein the VH and VL form an antigen binding domain that binds human CD8, NKG2A, or NKG2D.

Fab×ncIL-15/Rα

This embodiment is shown in FIG. 57E, and comprises four monomers. The first monomer comprises, from N- to C-terminus, the sushi domain-domain linker-CH2-CH3, and the second monomer comprises a heavy chain, VH-CH1-hinge-CH2-CH3. The third monomer is the IL-15 domain. The fourth monomer is a light chain, VL-CL This is generally referred to as "Fab×ncIL-15/Rα", with the "nc" standing for "non-covalent" referring to the self-assembling non-covalent attachment of the IL-15 and sushi domain. A preferred combination of variants for this embodiment are found in FIG. 92C.

Referring to FIG. 57E, the Fab×ncIL-15/Rα (or ncIL-15/Rα×Fab) format comprises a VH fused to the N-terminus of a heterodimeric Fc-region, with IL-15Rα(sushi) fused to the other side of the heterodimeric Fc, while a corresponding light chain is transfected separately so as to form a Fab with the VH, and while IL-15 is transfected separately so that a non-covalent IL-15/Rα complex is formed. An illustrative embodiment of such a heterodimeric protein can be XENP25137.

In the Fab×ncIL-15/Rα format, one preferred embodiment utilizes the skew variant pair S364K/E357Q:L368D/K370S.

In the Fab×ncIL-15/Rα format, one preferred embodiment utilizes the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236/S267K on both monomers, and optionally the 428L/434S variants on both sides.

A preferred embodiment utilizes an anti-CD8 ABD and has the sequence of human_IL15Rα(Sushi)_Fc(216)_IgG1_pI(−)_Isosteric_A_C220S/PVA_/S267K/L368D/K370S IL-15Rα(sushi)-Fc chain (chain 1), IL15_D30N/E64Q/N65D (chain 2), OKT8[CD8]_H2_IgG1_PVA_/S267K/S364K/E357Q heavy chain (chain 3), and OKT8[CD8]_L1 light chain (chain 4), as shown in FIG. 92C.

In the Fab×ncIL-15/Rα format, one preferred embodiment utilizes a ncIL-15/Rα complex having a sequence of human_IL15Rα(Sushi)_Fc(216)_IgG1_pI(−) Isosteric_A_C220S/PVA_/S267K/L368D/K370S IL-15Rα(sushi)-Fc chain (chain 1) and IL15_D30N/E64Q/N65D (chain 2), as shown in FIG. 92C.

In some embodiments, the heterodimeric protein comprises: a) a first monomer comprising a heavy chain comprising VH-CH1-hinge-CH2-CH3, wherein said CH2-CH3 is a first variant Fc domain; b) a second monomer comprising, from N- to C-terminus; i) an IL-15 sushi domain; ii) a first domain linker; iii) a second variant Fc domain comprising CH2-CH3; c) a third monomer comprising a variant IL-15 domain; and d) a fourth monomer comprising a light chain comprising VL-CL; wherein the VH and VL form an antigen binding domain that binds human CD8, NKG2A, or NKG2D.

FabxdsIL-15/Rα

This embodiment is shown in FIG. 57F, and comprises four monomers. The first monomer comprises, from N- to C-terminus, the sushi domain-domain linker-CH2-CH3, wherein the sushi domain has been engineered to contain a cysteine residue, and the second monomer comprises a heavy chain, VH-CH1-hinge-CH2-CH3. The third monomer is the IL-15 domain, also engineered to have a cysteine residue, such that a disulfide bridge is formed under native cellular conditions. The fourth monomer is a light chain, VL-CL. This is generally referred to as "FabxdsIL-15/Rα", with the "ds" standing for "disulfide" referring to the self-assembling non-covalent attachment of the IL-15 and sushi domain.

Referring to FIG. 57F, the FabxdsIL-15/Rα (or dsIL-15/RαxFab) format comprises a VH fused to the N-terminus of a heterodimeric Fc-region, with IL-15Rα(sushi) fused to the other side of the heterodimeric Fc, while a corresponding light chain is transfected separately so as to form a Fab with the VH, and while IL-15 is transfected separately so that a covalent IL-15/Rα complex is formed as a result of engineered cysteines.

In the FabxdsIL-15/Rα format, one preferred embodiment utilizes the skew variant pair S364K/E357Q:L368D/K370S.

In the FabxdsIL-15/Rα format, one preferred embodiment utilizes the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides.

In some embodiments, the heterodimeric protein comprises: a) a first monomer comprising a heavy chain comprising VH-CH1-hinge-CH2-CH3, wherein said CH2-CH3 is a first variant Fc domain; b) a second monomer comprising, from N- to C-terminus: i) a variant IL-15 sushi domain with a cysteine residue; ii) a first domain linker; and iii) a second variant Fc domain comprising CH2-CH3; c) a third monomer comprising a variant IL-15 domain comprising a cysteine residue; and d) a fourth monomer comprising a light chain comprising VL-CL; and wherein the variant IL-15 sushi domain and the variant IL-15 domain form a disulfide bond, and the VH and VL form an antigen binding domain that binds human CD8, NKG2A, or NKG2D.

mAb-scIL-15/Rα

This embodiment is shown in FIG. 57G, and comprises three monomers (although the fusion protein is a tetramer). The first monomer comprises a heavy chain, VH-CH1-hinge-CH2-CH3. The second monomer comprises a heavy chain with a scIL-15 complex, VH-CH1-hinge-CH2-CH3-domain linker-sushi domain-domain linker-IL-15. The third (and fourth) monomer are light chains, VL-CL. This is generally referred to as "mAb-scIL-15/Rα", with the "sc" standing for "single chain". Preferred combinations of variants for this embodiment are found in FIG. 79A.

Referring to FIG. 57G, the mAb-scIL-15/Rα format comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form a Fabs with the VHs. An illustrative embodiment of such a heterodimeric protein can be XENP24546.

In the mAb-scIL-15/Rα format, one preferred embodiment utilizes the skew variant pair S364K/E357Q:L368D/K370S.

A preferred embodiment utilizes an anti-CD8 ABD and has the sequence of 51.1[CD8]_H1-Fc-IL15Rα(sushi)_(GGGGS)5-IL15(single-chain), 51.1[CD8]_H1L1 Fab-Fc heavy chain (chain 2), and 51.1[CD8]_H1L1 light chain (chain 3), as shown in FIG. 79A.

In the mAb-scIL-15/Rα format, one preferred embodiment utilizes a scIL-15/Rα complex sequence of 51.1 [CD8]_H1-Fc-IL15Rα(sushi)_(GGGGS)5-IL15 (single-chain), as shown in FIG. 79A.

In some embodiments, the heterodimeric protein comprises: a) a first monomer comprising a heavy chain comprising VH-CH1-hinge-CH2-CH3, wherein said CH2-CH3 is a first variant Fc domain; b) a second monomer comprising VH-CH1-hinge-CH2-CH3-domain linker-IL-15 sushi domain-domain linker-IL-15 variant, wherein the CH2-CH3 is a second variant Fc domain; and c) a third monomer comprising a light chain comprising VL-CL; wherein the VH and VL domains bind human CD8, NKG2A, or NKG2D.

mAb-ncIL-15/Rα

This embodiment is shown in FIG. 57H, and comprises four monomers (although the heterodimeric fusion protein is a pentamer). The first monomer comprises a heavy chain, VH-CH1-hinge-CH2-CH3. The second monomer comprises a heavy chain with an IL-15Rα(sushi) domain, VH-CH1-hinge-CH2-CH3-domain linker-sushi domain. The third monomer is an IL-15 domain. The fourth (and fifth) monomer are light chains, VL-CL. This is generally referred to as "mAb-ncIL-15/Rα", with the "nc" standing for "non-covalent". Preferred combinations of variants for this embodiment are found in FIG. 79A.

Referring to FIG. 57H, the mAb-ncIL-15/Rα format comprises VH fused to the N-terminus of a first and a second heterodimeric Fc, with IL-15Rα(sushi) fused to the C-terminus of one of the heterodimeric Fc-region, while corresponding light chains are transfected separately so as to form a Fabs with the VHs, and while IL-15 is transfected separately so that a non-covalent IL-15/Rα complex is formed. An illustrative embodiment of such a heterodimeric protein can be XENP24543.

In the mAb-ncIL-15/Rα format, one preferred embodiment utilizes the skew variant pair S364K/E357Q:L368D/K370S.

A preferred embodiment utilizes an anti-CD8 ABD and has the sequence of 51.1[CD8]_H1L1_Fab-Fc-Heavy Chain-IL15Rα(sushi) (chain 1), 51.1[CD8]_H1L1_Fab-Fc heavy chain (chain 2), 51.1[CD8]_H1L1_Fab-Fc light chain (chain 3), and IL15(N65D) (chain 4), as shown in FIG. 79A.

In the mAb-ncIL-15/Rα format, one preferred embodiment utilizes a ncIL-15/Rα complex sequence of 51.1[CD8]_H1L1_Fab-Fc-Heavy Chain-IL15Rα(sushi) (chain 1) and IL15(N65D) (chain 4), as shown in FIG. 79A.

In some embodiments, the heterodimeric protein comprises: a) a first monomer comprising a heavy chain comprising VH-CH1-hinge-CH2-CH3, wherein the CH2-CH3 is a first variant Fc domain; b) a second monomer comprising VH-CH1-hinge-CH2-CH3-domain linker-IL-15 sushi domain, wherein the CH2-CH3 is a second variant Fc domain; c) a third monomer comprising a variant IL-15 domain; and d) a fourth monomer comprising a light chain comprising VL-CL; wherein the VH and VL domains bind human CD8, NKG2A, or NKG2D.

mAb-dsIL-15/Rα

This embodiment is shown in FIG. 57I, and comprises four monomers (although the heterodimeric fusion protein is a pentamer). The first monomer comprises a heavy chain, VH-CH1-hinge-CH2-CH3. The second monomer comprises a heavy chain with an IL-15Rα(sushi) domain: VH-CH1-hinge-CH2-CH3-domain linker-sushi domain, where the sushi domain has been engineered to contain a cysteine residue. The third monomer is an IL-15 domain, which has been engineered to contain a cysteine residue, such that the IL-15 complex is formed under physiological conditions. The fourth (and fifth) monomer are light chains, VL-CL. This is generally referred to as "mAb-dsIL-15/Rα", with the "ds" standing for "disulfide".

Referring to FIG. 57I, the mAb-dsIL-15/Rα format comprises VH fused to the N-terminus of a first and a second heterodimeric Fc, with IL-15Rα(sushi) fused to the C-terminus of one of the heterodimeric Fc-region, while corresponding light chains are transfected separately so as to form a Fabs with the VHs, and while and while IL-15 is transfected separately so that a covalently linked IL-15/Rα complex is formed as a result of engineered cysteines.

In the mAb-dsIL-15/Rα format, one preferred embodiment utilizes the skew variant pair S364K/E357Q:L368D/K370S.

In some embodiments, the heterodimeric protein comprises: a) a first monomer comprising a heavy chain comprising VH-CH1-hinge-CH2-CH3, wherein the CH2-CH3 is a first variant Fc domain; b) a second monomer comprising VH-CH1-hinge-CH2-CH3-domain linker-IL-15 sushi domain, wherein said variant IL-15 sushi domain comprises a cysteine residue and wherein the CH2-CH3 is a second variant Fc domain; c) a third monomer comprising a variant IL-15 domain comprising a cysteine residue; and d) a fourth monomer comprising a light chain comprising VL-CL; wherein the variant IL-15 sushi domain and the variant IL-15 domain form a disulfide bond and the VH and VL domains bind human CD8, NKG2A, or NKG2D.

Central-IL-15/Rα

This embodiment is shown in FIG. 57J, and comprises four monomers forming a tetramer. The first monomer comprises a VH-CH1-[optional domain linker]-IL-15-[optional domain linker]-CH2-CH3, with the second optional domain linker sometimes being the hinge domain. The second monomer comprises a VH-CH1-[optional domain linker]-sushi domain-[optional domain linker]-CH2-CH3, with the second optional domain linker sometimes being the hinge domain. The third (and fourth) monomers are light chains, VL-CL. This is generally referred to as "Central-IL-15/Rα". Preferred combinations of variants for this embodiment are found in FIG. 79B.

Referring to FIG. 57J, the central-IL-15/Rα format comprises a VH recombinantly fused to the N-terminus of IL-15 which is then further fused to one side of a heterodimeric Fc and a VH recombinantly fused to the N-terminus of IL-15Rα(sushi) which is then further fused to the other side of the heterodimeric Fc, while corresponding light chains are transfected separately so as to form a Fabs with the VHs. An illustrative embodiment of such a heterodimeric protein can be XENP24547.

In the central-IL-15/Rα format, one preferred embodiment utilizes the skew variant pair S364K/E357Q:L368D/K370S.

A preferred embodiment utilizes an anti-CD8 ABD and has the sequence of 51.1[CD8]_H1-IL15(N4D/N65D)-Fc (chain 1), 51.1[CD8]_H1-IL15Rα(sushi)-Fc (chain 2), 51.1[CD8]_H1L1 light chain (chain 3), as shown in FIG. 79B.

In the central-IL-15/Rα format, one preferred embodiment utilizes a IL-15/Rα complex sequence of 51.1[CD8]_H1-IL15(N4D/N65D)-Fc (chain 1) and 51.1[CD8]_H1-IL15Rα(sushi)-Fc, as shown in FIG. 79B.

In some embodiments, the heterodimeric protein comprises: a) a first monomer comprising, from N- to C-terminal, a VH-CH1-domain linker-variant IL-15 domain-domain linker-CH2-CH3, wherein said CH2-CH3 is a first variant Fc domain; b) a second monomer comprising, from N- to C-terminal, a VH-CH1-domain linker-variant IL-15 sushi domain-domain linker-CH2-CH3, wherein said CH2-CH3 is a first variant Fc domain; and c) a third monomer comprising a light chain comprising VL-CL; wherein the VH and the VL form an antigen binding domain that binds human CD8, NKG2A, or NKG2D.

Central-scIL-15/Rα

This embodiment is shown in FIG. 57K, and comprises four monomers forming a tetramer. The first monomer comprises a VH-CH1-[optional domain linker]-sushi domain-domain linker-IL-15-[optional domain linker]-CH2-CH3, with the second optional domain linker sometimes being the hinge domain. The second monomer comprises a VH-CH1-hinge-CH2-CH3. The third (and fourth) monomers are light chains, VL-CL. This is generally referred to as "Central-scIL-15/Rα", with the "sc" standing for "single chain". Preferred combinations of variants for this embodiment are found in FIG. 79B.

Referring to FIG. 57K, the central-scIL-15/Rα format comprises a VH fused to the N-terminus of IL-15Rα(sushi) which is fused to IL-15 which is then further fused to one side of a heterodimeric Fc and a VH fused to the other side of the heterodimeric Fc, while corresponding light chains are transfected separately so as to form a Fabs with the VHs. An illustrative embodiment of such a heterodimeric protein can be XENP24548.

In the central-scIL-15/Rα format, one preferred embodiment utilizes the skew variant pair S364K/E357Q:L368D/K370S.

A preferred embodiment utilizes an anti-CD8 ABD and has the sequence of 51.1[CD8]_H1-IL15Rα(sushi)_(GGGGS)5-IL15-Fc (chain 1), 51.1[CD8]_H1L1_Fab-Fc heavy chain (chain 2), 51.1[CD8]_H1L1 light chain (chain 3), as shown in FIG. 79B.

In the central-scIL-15/Rα format, one preferred embodiment utilizes scIL-15 complex sequence of 51.1[CD8]_H1-IL15Rα(sushi)_(GGGGS)5-IL15-Fc (chain 1) as shown in FIG. 79B.

In some embodiments, the heterodimeric protein comprises: a) a first monomer comprising from N- to C-terminus, VH-CH1-domain linker-IL-15 sushi domain-domain linker-variant IL-15 domain-domain linker-CH2-CH3, wherein said CH2-CH3 is a first variant Fc domain; b) a second monomer comprising a heavy chain comprising VH-CH1-hinge-CH2-CH3, wherein the CH2-CH3 is a second variant Fc domain; and c) a third monomer comprising a light chain comprising VL-CL; wherein the VH and the VL form an antigen binding domain that binds human CD8, NKG2A, or NKG2D.

In some embodiments, the antigen binding domain specifically binds human CD8 (such as the CD8 alpha chain). The human CD8 alpha chain polypeptide sequence is set forth in, e.g., Uniprot Accession No. P01732. One of skill in the art will appreciate that CD8 includes all isoform variants.

In some instances, the anti-CD8 ABD of the heterodimeric protein of the present invention has the sequences of 51.1 [CD8]_H1L1_Fab—Fc heavy chain and 51.1 [CD8]_H1L1 light chain, as shown in FIGS. 66A and 66B. In some instances, the anti-CD8 ABD of the heterodimeric protein of the present invention has the sequences of XENP24025: 1C11B3 [CD8]_H1L1 heavy chain (chain 1) and 1C11B3 [CD8]_H1L1 light chain (chain 2), or XENP24321: 1C11B3 [CD8]_H1L1_Fab—Fc heavy chain (chain 1), 1C11B3 [CD8]_H1L1 light chain (chain 2), and empty Fc (chain 3), as shown in FIG. 81. In other instances, the anti-CD8 ABD of the heterodimeric protein has the sequences of XENP15075 (OKT8_H1L1_IgG1_PVA_/S267K), as shown in FIG. 90. In particular instances, the anti-CD8 ABD of the heterodimeric protein has the sequences of XENP24920: OKT8[CD8]_H2_IgG1_PVA_/S267K/S364K/E357Q heavy chain (chain 2) and OKT8[CD8]_L1 light chain (chain 3), as shown in FIG. 91. The anti-CD8 ABD of the heterodimeric protein has the sequences of XENP26223: OKT8[CD8]_H2.157 IgG1_PVA_/S267K/S364K/E357Q heavy chain (chain 2) and OKT8[CD8]_L1.103 light chain (chain 3), as shown in FIG. 97A. In some instances, the anti-CD8 ABD of the heterodimeric protein has the sequences of XENP26585: OKT8[CD8]_H2.157_IgG1_PVA_/S267K/S364K/E357Q/M428L/N434S heavy chain (chain 2) and OKT8[CD8]_L1.103 light chain (chain 3), as shown in FIG. 102.

In some embodiments, the invention provides a heterodimeric Fc fusion protein comprising one or more ABDs that bind CD8 and an IL-15/IL-15Rα fusion protein, and can be any format shown in FIGS. 57A-57F. In one embodiment, a heterodimeric Fc fusion protein comprising two antigen binding domains that bind to CD8 and an IL-15/IL-15Rα fusion protein, and can be any format shown in FIGS. 57G-57K.

In some embodiments, the IL-15/IL-15Rα×anti-CD8 heterodimeric fusion protein comprises Fc domains with skew variants, with particularly useful skew variants being selected from the group consisting of S364K/E357Q: L368D/K370S; L368D/K370W:S364K; L368E/L370S: S364K; T411T/K360E/Q362E:D401K; L368D/K370S: S364K/E357L; K370S:S364K/E357Q; T366S/L368A/Y407V:T366W; and T366W/L368A/Y407V/Y349C: T366W/S354C, according to EU numbering.

In other embodiments, the IL-15/IL-15Rα×anti-CD8 heterodimeric fusion protein comprises Fc domains with pI variants, with particularly useful pI variants being N208D/Q295E/N384D/Q418E/N421D, according to EU numbering.

In another embodiment, the IL-15/IL-15Rα×anti-CD8 heterodimeric fusion protein comprises Fc domains with ablation variants, with particularly useful ablation variants being E233P/L234V/L235A/G236del/S267K. In yet another embodiment, the IL-15/IL-15Rα×anti-CD8 heterodimeric fusion protein comprises Fc domains with FcRn variants, with particularly useful FcRn variants being 428L/434S, according to EU numbering.

Exemplary embodiments of the IL-15/IL-15Rα×anti-CD8 heterodimeric fusion protein can include any of XENP24114, XENP24115, XENP24116, XENP24543, XENP24546, XENP24547, XENP24548, XENP24736, XENP24917, XENP24918, XENP24919, XENP25137, XENP26223, XENP26224, XENP26227, XENP26229, and XENP26585. Useful formats are represented in FIGS. 66A, 66B, 79A, 79B, 87, 92A, 92B, 92C, 97A, and 97B.

In other embodiments, the antigen binding domain specifically binds human NKG2A. The human NKG2A polypeptide sequence is set forth in, e.g., Uniprot Accession No. P26715. One of skill in the art will appreciate that NKG2A includes all isoform variants. In some instances, the anti-NKG2A ABD of the heterodimeric protein of the present invention has the sequences of monalizumab [NKG2A]_H1L1 Fab—Fc heavy chain and monalizumab [NKG2A]_H1L1 light chain, as shown in FIGS. 60A and 60B. In some embodiments, the invention provides a bifunctional heterodimeric Fc fusion protein comprising an ABD that binds to NKG2A and an IL-15/IL-15Rα fusion protein, and can be any format shown in FIGS. 57A-57F. In one embodiment, a bifunctional heterodimeric Fc fusion protein comprising two antigen binding domains that bind to NKG2A and an IL-15/IL-15Rα fusion protein, and can be any format shown in FIGS. 57G-57K. Exemplary embodiments of the IL-15/IL-15Rα×anti-NKG2A heterodimeric fusion protein (e.g., a scIL-15/Rα×anti-NKG2A Fab format) can include any of XENP24531, XENP24532, and XENP27146.

In another embodiment, the antigen binding domain specifically binds human NKG2D. The human NKG2D polypeptide sequence is set forth in, e.g., Uniprot Accession No. P26718. One of skill in the art will appreciate that NKG2D includes all isoform variants. In some instances, the anti-NKG2D ABD of the heterodimeric protein of the present invention has the sequences of MS [NKG2D]_H0L0 Fab-Fc heavy chain and MS [NKG2D]_H0L0 light chain, as shown in FIGS. 61A and 61B. In some embodiments, the invention provides a bifunctional heterodimeric Fc fusion protein comprising an ABD that binds to NKG2D and an IL-15/IL-15Rα fusion protein, and can be any format shown in FIGS. 57A-57F. In one embodiment, a bifunctional heterodimeric Fc fusion protein comprising two antigen binding domains that bind to NKG2D and an IL-15/IL-15Rα fusion protein, and can be any format shown in FIGS. 57G-57K. Exemplary embodiments of the IL-15/IL-15Rα×anti-NKG2D heterodimeric fusion protein (e.g., a scIL-15/Rα×anti-NKG2D Fab format) can include any of XENP24533, XENP24534, and XENP27145.

In some embodiments, the first and the second Fc domains can have a set of amino acid substitutions selected from the group consisting of [S364K/E357Q: L368D/K370S]; [S364K/E357Q:L368E/K370S]; [L368D/K370W:S364K]; [L368D/K370S:S364K]; [L368E/L370S:S364K]; [L368E/K370S:S364K]; [T411T/K360E/Q362E:D401K]; [L368D/K370S:S364K/E357L]; [K370S:S364K/E357Q]; [T366S/L368A/Y407V:T366W]; [T366S/L368A/Y407V/Y394C: T366W/S354C]; and [T366W/L368A/Y407V/Y349C: T366W/S354C], according to EU numbering. In some embodiments, the first and/or the second Fc domains have an additional set of amino acid substitutions comprising N208D/Q295E/N384D/Q418E/N421D, according to EU numbering. In other instances, the first and/or the second Fc domains have an additional set of amino acid substitutions consisting of G236R/L328R, E233P/L234V/L235A/ G236del/S239K, E233P/L234V/L235A/G236del/S267K, E233P/L234V/L235A/G236del/S239K/A327G, E233P/ L234V/L235A/G236del/S267K/A327G and E233P/L234V/ L235A/G236del, according to EU numbering. In some instances, the first and/or the second Fc domains have an additional set of amino acid substitutions consisting of 428L/434S (e.g., M428L/N434S), according to EU numbering.

In other aspects, provided herein is a bifunctional heterodimeric protein selected from the group consisting of XENP24114, XENP24115, XENP24116, XENP24531, XENP24532, XENP24533, XENP24534, XENP24543, XENP24546, XENP24547, XENP24548, XENP24736, XENP24917, XENP24918, XENP24919, XENP25137, XENP26223, XENP26224, XENP26227, XENP26229, XENP26585, XENP27145, and XENP27146.

Nucleic acids, expression vectors and host cells are all provided as well, in addition to methods of making these proteins and treating patients with them.

In one aspect, the heterodimeric protein described herein comprises (a) an IL-15/IL-15Rα fusion protein comprising an IL-15Rα protein, an IL-15 protein, and a first Fc domain, wherein the IL-15Rα protein is covalently attached to the N-terminus of the IL-15 protein using a first domain linker and the IL-15 protein is covalently attached to the N-terminus of the first Fc domain using a second domain linker, or wherein the IL-15 protein is covalently attached to the N-terminus of the IL-15Rα protein using a first domain linker and the IL-15Rα protein is covalently attached to the N-terminus of the first Fc domain using a second domain linker; and (b) an antigen binding domain monomer comprising a heavy chain comprising a VH-CH1-hinge-CH2-CH3 monomer, wherein VH is a variable heavy chain and CH2-CH3 is a second Fc domain, and a light chain comprising a variable light chain and a light constant domain (e.g., VL-CL); wherein the first and the second Fc domains have a set of amino acid substitutions selected from the group consisting of S267K/L368D/K370S:S267K/S364K/E357Q; S364K/E357Q:L368D/K370S; L368D/K370S:S364K; L368E/K370S:S364K; T411T/K360E/Q362E:D401K; L368D/K370S:S364K/E357L and K370S:S364K/E357Q, according to EU numbering. In some embodiments, the first and/or second Fc domains have an additional set of amino acid substitutions comprising Q295E/N384D/Q418E/N421D, according to EU numbering. In particular embodiments, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering. The IL-15 protein may have an amino acid sequence selected from the group consisting of SEQ ID NO:1 (full-length human IL-15) and SEQ ID NO:2 (truncated human IL-15), and the IL-15Rα protein has an amino acid sequence selected from the group consisting of SEQ ID NO:3 (full-length human IL-15Rα) and SEQ ID NO:4 (sushi domain of human IL-15Rα). In some embodiments, the IL-15 protein and the IL-15Rα protein have a set of amino acid substitutions selected from the group consisting of E87C:D96/P97/C98; E87C:D96/C97/A98; V49C:540C; L52C:540C; E89C:K34C; Q48C:G38C; E53C:L42C; C42S:A37C; and L45C:A37C, respectively. The IL-15 protein may have one or more amino acid substitutions selected from the group consisting of D61N, N65D, and Q108E. In some embodiments, the IL-15 protein has the amino acid substitution D61N, N65D, or Q108E. In other embodiments, the IL-15 protein has the amino acid substitutions of D61N/N65D, D61N/Q108E, or N65D/Q108E. In particular embodiments, the IL-15 protein has the amino acid substitutions of D61N/N65D/Q108E. In some embodiments the antigen binding domain monomer binds to an antigen selected from the group consisting of CD8, NKG2A, and NKG2D. In other words, the antigen binding domain monomer may bind CD8. The antigen binding domain monomer may bind NKG2A. In some cases, the antigen binding domain monomer may bind NKG2D. In some embodiments, the antigen binding domain monomer is a Fab. The heterodimeric protein may be referred to herein as a "scIL-15/Rα(sushi)×Fab". In some embodiments, the heterodimeric protein is XENP24114, XENP24115, XENP24116, XENP24531, XENP24532, XENP24533, or those depicted in FIG. 66A, FIG. 66B, FIG. 60A, or FIG. 61A. In other embodiments, the heterodimeric protein described above also includes an antigen binding domain covalently attached to the N-terminus of said IL-15 protein or IL-15Rα protein using a domain linker, wherein said antigen binding domain comprises a second variable heavy chain domain and a second variable light chain domain and does not include an Fc domain. Such a heterodimeric protein can be XENP24548 or those depicted in FIG. 79B.

In another aspect, the bifunctional heterodimeric protein described herein comprises (a) a fusion protein comprising a first protein domain and a first Fc domain, wherein the first protein domain is covalently attached to the N-terminus of the first Fc domain using a domain linker; (b) a second protein domain noncovalently attached to the first protein domain; and (c) an antigen binding domain monomer comprising a heavy chain comprising a VH-CH1-hinge-CH2-CH3 monomer, wherein VH is a variable heavy chain and CH2-CH3 is a second Fc domain, and a light chain comprising a variable light chain and a light constant domain (e.g., VL-CL). The first and the second Fc domains can have a set of amino acid substitutions selected from the group consisting of S267K/L368D/K37S:S267K/S364K/E357Q; S364K/E357Q:L368D/K370S; L368D/K370S:S364K; L368E/K370S:S364K; T411T/K360E/Q362E:D401K; L368D/K37S:S364K/E357L and K370S:S364K/E357Q, according to EU numbering, and the first protein domain comprises an IL-15Rα protein and the second protein domain comprises an IL-15 protein, or the first protein domain comprises an IL-15 protein and the second protein domain comprises an IL-15Rα protein. In some embodiments, the first and/or said second Fc domains have an additional set of amino acid substitutions comprising Q295E/N384D/Q418E/N421D, according to EU numbering. In certain embodiments, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering. The IL-15 protein can have an amino acid sequence selected from the group consisting of SEQ ID NO:1 (full-length human IL-15) and SEQ ID NO:2 (truncated human IL-15), and the IL-15Rα protein can have an amino acid sequence selected from the group consisting of SEQ ID NO:3 (full-length human IL-15Rα) and SEQ ID NO:4 (sushi domain of human IL-15Rα). In various embodiments, the IL-15 protein and the IL-15Rα protein have a set of amino acid substitutions selected from the group consisting of E87C:D96/P97/C98; E87C:D96/C97/A98; V49C:540C; L52C:540C; E89C:K34C; Q48C:G38C; E53C:L42C; C42S:A37C; and L45C:A37C, respectively. The IL-15 protein may have one or more amino acid substitutions selected from the group consisting of D61N, N65D, and Q108E. In some embodiments, the IL-15 protein has the amino acid substitution D61N, N65D, or Q108E. In other embodiments, the IL-15 protein has the amino acid substitutions of D61N/N65D, D61N/Q108E, or N65D/Q108E. In particular embodiments, the IL-15 protein has the amino acid substitutions of D61N/N65D/Q108E. In some embodiments the antigen binding domain monomer binds to an antigen selected from the group consisting of CD8, NKG2A, and NKG2D. In other words, the antigen binding domain monomer may bind CD8. The antigen binding domain monomer may bind NKG2A. In some cases, the antigen binding domain monomer may bind NKG2D. In some embodiments, the antigen binding domain monomer is a Fab. Such a heterodimeric protein may be referred to herein as a "ncIL-15/RαxFab". In some instance, the heterodimeric protein can be XENP25137 or those depicted in FIG. 57E and FIG. 92C. In certain embodiments, the antigen binding domain monomer is an scFv, and not a Fab. Such a heterodimeric protein may be referred to herein as a "ncIL-15/RαxscFv" and is depicted in FIG. 57B.

In other embodiments, the heterodimeric protein comprises an antigen binding domain covalently attached to the N-terminus of the IL-15 protein and/or IL-15Rα protein using one or more domain linkers, wherein the antigen binding domain comprises a second variable heavy chain domain and a second variable light chain domain and does not include an Fc domain. Such as a heterodimer protein represented in FIGS. 1I, 1L, or 1K of U.S. 62/527,898 filed Jun. 30, 2017.

In another aspect, the heterodimeric protein described herein comprises (a) a first antigen binding domain monomer comprising a first heavy chain comprising a first VH-CH1-hinge-CH2-CH3 monomer, wherein VH is a first variable heavy chain and CH2-CH3 is a first Fc domain, and a first light chain comprising a first variable light chain and a first light constant domain; b) a second antigen binding domain monomer comprising a second heavy chain comprising a second VH-CH1-hinge-CH2-CH3 monomer, wherein VH is a second variable heavy chain and CH2-CH3 is a second Fc domain, a second light chain comprising a second variable light chain and a second light constant domain, and a first protein domain that is covalently attached to the C-terminus of the second Fc domain using a first domain linker; and c) a second protein domain is attached or noncovalently attached to the first protein domain of the second antigen binding domain monomer; wherein the first and the second Fc domains have a set of amino acid substitutions selected from the group consisting of S267K/L368D/K370S:S267K/S364K/E357Q; S364K/E357Q: L368D/K370S; L368D/K370S:S364K; L368E/K370S: S364K; T411T/K360E/Q362E:D401K; L368D/K370S: S364K/E357L and K370S:S364K/E357Q, according to EU numbering. The first and/or the second Fc domains may have an additional set of amino acid substitutions comprising Q295E/N384D/Q418E/N421D, according to EU numbering. The first and/or the second Fc domains may have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering. The IL-15 protein can have an amino acid sequence selected from the group consisting of SEQ ID NO:1 (full-length human IL-15) and SEQ ID NO:2 (truncated human IL-15), and the IL-15Rα protein can have an amino acid sequence selected from the group consisting of SEQ ID NO:3 (full-length human IL-15Rα) and SEQ ID NO:4 (sushi domain of human IL-15Rα). In various embodiments, the IL-15 protein and the IL-15Rα protein have a set of amino acid substitutions selected from the group consisting of E87C:D96/P97/C98; E87C:D96/C97/A98; V49C:540C; L52C:540C; E89C: K34C; Q48C:G38C; E53C:L42C; C42S:A37C; and L45C: A37C, respectively. The IL-15 protein may have one or more amino acid substitutions selected from the group consisting of D61N, N65D, and Q108E. In some embodiments, the IL-15 protein has the amino acid substitution D61N, N65D, or Q108E. In other embodiments, the IL-15 protein has the amino acid substitutions of D61N/N65D, D61N/Q108E, or N65D/Q108E. In particular embodiments, the IL-15 protein has the amino acid substitutions of D61N/N65D/Q108E. In preferred embodiments, the IL-15 protein comprises the amino acid substitutions N4D/N65D or D30N/E64Q/N65D. In preferred embodiments, the IL-15 protein comprises the amino acid substitutions N4D/N65D or D30N/E64Q/N65D. In some embodiments the first antigen binding domain monomer and the second antigen binding domain monomer binds to an antigen selected from the group consisting of CD8, NKG2A, and NKG2D. In other embodiments the first antigen binding domain monomer or the second antigen binding domain monomer binds to an antigen selected from the group consisting of CD8, NKG2A, and NKG2D. In other words, the antigen binding domain monomer(s) may bind CD8. The antigen binding domain monomer(s) may bind NKG2A. In some cases, the antigen binding domain monomer(s) may bind NKG2D. In some embodiments, the first and second antigen binding domain monomers form a monoclonal antibody (mAb). Such a heterodimeric protein may be referred to herein as a "mAb-scIL-15/Rα". In some instance, the heterodimeric protein can be XENP25137 or those depicted in FIG. 57G and FIG. 79A.

In another aspect, the heterodimeric protein described herein comprises (a) an IL-15 fusion protein comprising an IL-15 protein, a first antigen binding domain, and a first Fc domain, wherein the first antigen binding domain is covalently attached to the N-terminus of the IL-15 protein using a first domain linker, the IL-15 protein is covalently attached to the N-terminus of the first Fc domain using a second domain linker, and the antigen binding domain comprises a first variable heavy chain domain and a first variable light chain domain and does not include an Fc domain; (b) an IL-15Rα fusion protein comprising an IL-15Rα protein, a second antigen binding domain, and a second Fc domain, wherein a second antigen binding domain is covalently attached to the N-terminus of the IL-15Rα protein using a third domain linker, the IL-15Rα protein is covalently attached to the N-terminus of the second Fc domain using a fourth domain linker, and the second antigen binding domain comprises a second variable heavy chain domain and a second variable light chain domain and does not include an Fc domain; wherein the first and the second Fc domains have a set of amino acid substitutions selected from the group consisting of S267K/L368D/K370S:S267K/S364K/E357Q; S364K/E357Q:L368D/K370S; L368D/K370S:S364K; L368E/K370S:S364K; T411T/K360E/Q362E:D401K; L368D/K370S:S364K/E357L and K370S: S364K/E357Q, according to EU numbering. The first and/or the second Fc domains may have an additional set of amino acid substitutions comprising Q295E/N384D/Q418E/N421D, according to EU numbering. The first and/or the second Fc domains may have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering. The IL-15 protein can have an amino acid sequence selected from the group consisting of SEQ ID NO:1 (full-length human IL-15) and SEQ ID NO:2 (truncated human IL-15), and the IL-15Rα protein can have an amino acid sequence selected from the group consisting of SEQ ID NO:3 (full-length human IL-15Rα) and SEQ ID NO:4 (sushi domain of human IL-15Rα). In various embodiments, the IL-15 protein and the IL-15Rα protein have a set of amino acid substitutions selected from the group consisting of E87C: D96/P97/C98; E87C:D96/C97/A98; V49C:S40C; L52C: S40C; E89C:K34C; Q48C:G38C; E53C:L42C; C42S: A37C; and L45C:A37C, respectively. The IL-15 protein may have one or more amino acid substitutions selected from the group consisting of D61N, N65D, and Q108E. In some embodiments, the IL-15 protein has the amino acid substitution D61N, N65D, or Q108E. In other embodiments, the IL-15 protein has the amino acid substitutions of D61N/ N65D, D61N/Q108E, or N65D/Q108E. In particular embodiments, the IL-15 protein has the amino acid substitutions of D61N/N65D/Q108E. In preferred embodiments, the IL-15 protein comprises the amino acid substitutions N4D/N65D or D30N/E64Q/N65D. In some embodiments the first antigen binding domain monomer and the second antigen binding domain monomer binds to an antigen selected from the group consisting of CD8, NKG2A, and NKG2D. In other embodiments the first antigen binding domain monomer or the second antigen binding domain monomer binds to an antigen selected from the group consisting of CD8, NKG2A, and NKG2D. In other words, the antigen binding domain monomer(s) may bind CD8. The antigen binding domain monomer(s) may bind NKG2A. In some cases, the antigen binding domain monomer(s) may bind NKG2D. In some embodiments, the heterodimeric protein is XENP24547 or as represented in FIG. 57J and FIG. 79B.

Also provided herein is a nucleic acid composition comprising one or more nucleic acids encoding any one of the bifunctional heterodimeric proteins described herein. In another aspect, the invention provides an expression vector composition comprising one or more expression vectors, each vector comprising a nucleic acid such that the one or more expression vectors encode any one of the heterodimeric proteins described herein. In other aspects, host cell comprising any one of the nucleic acid compositions or expression vector compositions is provided. In another aspect, the invention provides a method of producing any one of the heterodimeric protein described herein. The method comprises (a) culturing such a host cell under suitable conditions wherein the heterodimeric protein is expressed, and (b) recovering the heterodimeric protein. In yet another aspect, the invention provides a method of treating cancer in a patient, e.g, a human patient comprising administering a therapeutically effective amount of any one of the heterodimeric protein disclosed herein to the patient. In some instances, provided herein is a method of treating cancer in a patient in need thereof.

VIII. Nucleic Acids of the Invention

The invention further provides nucleic acid compositions encoding the bifunctional IL-15/IL-15Rα×antigen binding domain heterodimeric fusion protein of the invention.

As will be appreciated by those in the art, the nucleic acid compositions will depend on the format of the bifunctional heterodimeric fusion protein. Thus, for example, when the format requires three amino acid sequences, three nucleic acid sequences can be incorporated into one or more expression vectors for expression. Similarly for some formats, only two nucleic acids are needed; again, they can be put into one or two expression vectors.

As is known in the art, the nucleic acids encoding the components of the invention can be incorporated into expression vectors as is known in the art, and depending on the host cells used to produce the bifunctional heterodimeric fusion proteins of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g., CHO cells), finding use in many embodiments.

In some embodiments, nucleic acids encoding each monomer, as applicable depending on the format, are each contained within a single expression vector, generally under different or the same promoter controls. In embodiments of particular use in the present invention, each of these two or three nucleic acids is contained on a different expression vector. As shown herein and in U.S. Provisional Application No. 62/025,931, U.S. Patent Application Publication No. 2015/0307629, and International Patent Publication No. WO 2015/149077 (all hereby incorporated by reference), different vector rations can be used to drive heterodimer formation. That is, surprisingly, while the proteins comprise a first monomer:second monomer:light chains (such as an embodiment that has three polypeptides comprising a heterodimeric antibody) in a 1:1:2 ratio, these are not the ratios that produce the best results.

The bifunctional heterodimeric fusion proteins of the invention are made by culturing host cells comprising the expression vector(s) as is well known in the art. Once produced, traditional fusion protein or antibody purification steps are done, including an ion exchange chromotography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that each monomer has a different pI and the heterodimer also has a distinct pI, thus facilitating isoelectric purification of the heterodimer (e.g., anionic exchange chromatography, cationic exchange chromatography). These substitutions also aid in the determination and monitoring of any contaminating homodimers post-purification (e.g., IEF gels, cIEF, and analytical IEX columns).

IX. Biological and Biochemical Functionality of Bifunctional IL-15/IL-15Rα×Antigen Binding Domain Heterodimeric Fusion Proteins Generally the bifunctional IL-15/IL-15Rα×antigen binding domain heterodimeric fusion proteins of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g., presence of ICOS+ CD4+ T cells following ipilimumab treatment) along with other measurements such as tumor burden, size, invasiveness, lymph node (LN) involvement, metastasis, etc. can be done. Thus, any or all of the following can be evaluated: the inhibitory effects of PVRIG on CD4+ T cell activation or proliferation, CD8+ T (CTL) cell activation or proliferation, CD8+ T cell-mediated cytotoxic activity and/or CTL mediated cell depletion, NK cell activity and NK mediated cell depletion, the potentiating effects of checkpoints on Treg cell differentiation and proliferation and Treg- or myeloid derived suppressor cell (MDSC)-mediated immunosuppression or immune tolerance, and/or the effects of the checkpoints on proinflammatory cytokine production by immune cells, e.g., IL-2, IFN-γ or TNF-α production by T or other immune cells.

In some embodiments, assessment of treatment is done by evaluating immune cell proliferation, using for example, CFSE dilution method, Ki67 intracellular staining of immune effector cells, and $^3$H-thymidine incorporation method.

In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are performed as is known in the art.

In general, protein expression measurements are also similarly performed as is known in the art.

In some embodiments, assessment of treatment is performed by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, calcein-AM assay, luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs).

A. Assays to Measure Efficacy and Potency

In some embodiments, T cell activation is assessed using a Mixed Lymphocyte Reaction (MLR) assay as is known in the art. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC.

A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in $\alpha\beta$ and/or $\gamma\delta$ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases $\alpha\beta$ and/or $\gamma\delta$ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7, etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, $^{15}$Cr release, calcein AM, or by flow cytometry based assays like for an example CFSE dilution or propidium iodide staining, etc. An increase in activity indicates immunostimulatory activity. Appropriate increases in activity are outlined below.

In one embodiment, the signaling pathway assay measures increases or decreases in stimulation of cytotoxic or cytostatic effect on cancer cells as measured for an example by cytotoxicity assays such as for an example MTT, $^{15}$Cr release, calcein AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, $^{15}$Cr release, calcein AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, $^{15}$Cr release, calcein AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g. CD25, CD69, CD137, PD1), cytotoxicity (ability to kill target cells), and cytokine production (e.g. IL-2, IL-4, IL-6, IFNγ, TNF-a, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g., IFNγ and TNF), and cell surface receptor expression (e.g., CD25) would be indicative of immune modulation that would be consistent with enhanced killing of cancer cells.

In one embodiment, $\gamma\delta$ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an IL-15/IL-15Rα×antigen binding domain heterodimeric fusion protein of the invention. Similarly, increases of at least one-, two-, three-, four- or five-fold as compared to reference or control samples show efficacy.

X. Treatments

Once made, the compositions of the invention find use in a number of oncology applications, by treating cancer, generally by promoting T cell activation (e.g., T cells are no longer suppressed) with the binding of the heterodimeric Fc fusion proteins of the invention.

Accordingly, the bifunctional heterodimeric compositions of the invention find use in the treatment of these cancers.

A. Bifunctional Heterodimeric Protein Compositions for In Vivo Administration In some embodiments, bifunctional heterodimeric proteins of the present invention are co-administered with a separate antibody. Co-administration can be performed simultaneously or sequentially, as will be appreciated by those in the art.

Formulations of antibodies used in accordance with the present invention are prepared for storage by mixing an antibody having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions. Acceptable carriers, buffers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

B. Administrative Modalities

The bifunctional heterodimeric proteins of the invention can be administered with a chemotherapeutic agent to a subject, in accord with known methods, such as intravenous administration as a bolus or by continuous infusion over a period of time. Administration of the bifunction heterodimer protein and a chemotherapeutic agent can be performed simultaneously or sequentially, as will be appreciated by those in the art

C. Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the bifunctional heterodimeric protein, antigen binding domain, or portions thereof are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound or composition to inhibit cell growth or to induce apoptosis by in vitro assays known to the skilled practitioner. A therapeutically effective amount of a therapeutic compound or composition may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the bifunctional heterodimeric proteins used in the present invention depend on the disease or condition to be treated and may be determined by the persons skilled in the art.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in U.S. Patent Application Publication Nos. 2015/0307629, and 2014/0288275 and International Patent Publication No. WO2014/145806, all of which are expressly incorporated by reference in their entirety and particularly for the techniques outlined therein.

Example 1: IL-15/IL-15Rα Fc Fusion Proteins

1A: Engineering IL-15/Rα-Fc Fusion Proteins

In order to address the short half-life of IL-15/IL-15Rα heterodimers, the IL-15/IL-15Rα(sushi) complex was generated as a Fc fusion (hereon referred to as IL-15/Rα-Fc fusion proteins) with the goal of facilitating production and promoting FcRn-mediated recycling of the complex and prolonging half-life.

Plasmids coding for IL-15 or IL-15Rα sushi domain were constructed by standard gene synthesis, followed by subcloning into a pTT5 expression vector containing Fc fusion partners (e.g., constant regions as depicted in FIG. 8). Cartoon schematics of illustrative IL-15/Rα-Fc fusion protein formats are depicted in FIGS. 16A-16G.

Illustrative proteins of the IL-15/Rα-heteroFc format (FIG. 16A) include XENP20818 and XENP21475, sequences for which are depicted in FIG. 17. Illustrative proteins of the scIL-15/Rα-Fc format (FIG. 16B) include XENP21478 and XENP21993, sequences for which are depicted in FIG. 18. Illustrative proteins of the ncIL-15/Rα-Fc format (FIG. 16C) include XENP21479, XENP22366, and XENP24348 sequences for which are depicted in FIG. 19. An illustrative protein of the bivalent ncIL-15/Rα-Fc format (FIG. 16D) is XENP21978, sequences for which are depicted in FIG. 20. Sequences for an illustrative protein of the bivalent scIL-15/Rα-Fc format (FIG. 16E) are depicted in FIG. 21. Illustrative proteins of the Fc-ncIL-15/Rα format (FIG. 16F) are XENP22637 and XENP22638, sequences for which are depicted in FIG. 22. Sequences for an illustrative protein of the Fc-scIL-15/Rα format (FIG. 16G) are depicted in FIG. 23.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

IL-15/Rα-Fc fusion proteins in the various formats as described above were tested in a cell proliferation assay. Human PBMCs were treated with the test articles at the indicated concentrations. 4 days after treatment, the PBMCs were stained with anti-CD8-FITC (RPA-T8), anti-CD4-PerCP/Cy5.5 (OKT4), anti-CD27-PE (M-T271), anti-CD56-BV421 (5.1H11), anti-CD16-BV421 (3G8), and anti-CD45RA-BV605 (Hi100) to gate for the following cell types: CD4+ T cells, CD8+ T cells, and NK cells (CD56+/CD16+). Ki67 is a protein strictly associated with cell proliferation, and staining for intracellular Ki67 was performed using anti-Ki67-APC (Ki-67) and Foxp3/Transcription Factor Staining Buffer Set (Thermo Fisher Scientific, Waltham, Mass.). The percentage of Ki67 on the above cell types was measured using FACS (depicted in FIGS. 24A-24C and 25A-25C). The various IL-15/Rα-Fc fusion proteins induced strong proliferation of CD8+ T cells and NK cells. Notably, differences in proliferative activity were dependent on the linker length on the IL-15-Fc side. In particular, constructs having no linker (hinge only), including XENP21471, XENP21474, and XENP21475, demonstrated weaker proliferative activity.

1B: IL-15/Rα-Fc Fusion Proteins with Engineered Disulfide Bonds

To further improve stability and prolong the half-life of IL-15/Rα-Fc fusion proteins, disulfide bonds were engineered into the IL-15/Rα interface. By examining the crystal structure of the IL-15/Rα complex, as well as by modeling using Molecular Operating Environment (MOE; Chemical Computing Group, Montreal, Quebec, Canada) software, it was predicted that residues at the IL-15/Rα interface may be substituted with cysteine in order to form covalent disulfide bonds, as depicted in FIG. 26. Additionally, up to three amino acids following the sushi domain in IL-15Rα were added to the C-terminus of IL-15Rα(sushi) as a scaffold for engineering cysteines (illustrative sequences for which are depicted in FIG. 27). Sequences for illustrative IL-15 and IL-15Rα(sushi) variants engineered with cysteines are respectively depicted in FIGS. 28 and 29.

Plasmids coding for IL-15 or IL-15Rα(sushi) were constructed by standard gene synthesis, followed by subcloning into a pTT5 expression vector containing Fc fusion partners (e.g., constant regions as depicted in FIG. 8). Residues identified as described above were substituted with cysteines by standard mutagenesis techniques. Cartoon schematics of IL-15/Rα-Fc fusion proteins with engineered disulfide bonds are depicted in FIGS. 30A-30D.

Illustrative proteins of the dsIL-15/Rα-heteroFc format (FIG. 30A) include XENP22013, XENP22014, XENP22015, and XENP22017, sequences for which are depicted in FIG. 31. Illustrative proteins of the dsIL-15/Rα-Fc format (FIG. 30B) include XENP22357, XENP22358, XENP22359, XENP22684, and XENP22361, sequences for which are depicted in FIG. 32. Illustrative protein of the bivalent dsIL-15/Rα-Fc format (FIG. 30C) include XENP22634, XENP22635, XENP22636 and XENP22687, sequences for which are depicted in FIG. 33. Illustrative proteins of the Fc-dsIL-15/Rα format (FIG. 30D) include XENP22639 and XENP22640, sequences for which are depicted in FIG. 34.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

After the proteins were purified, they were characterized by capillary isoelectric focusing (CEF) for purity and homogeneity. CEF was performed using LabChip GXII Touch HT (PerkinElmer, Waltham, Mass.) using Protein Express Assay LabChip and Protein Express Assay Reagent Kit carried out using the manufacturer's instructions. Samples were run in duplicate, one under reducing (with dithiothreitol) and the other under non-reducing conditions. Many of the disulfide bonds were correctly formed as indicated by denaturing non-reducing CEF, where the larger molecular weight of the covalent complex can be seen when compared to the controls without engineered disulfide bonds (FIG. 35).

The proteins were then tested in a cell proliferation assay. IL-15/Rα-Fc fusion proteins (with or without engineered disulfide bonds) or controls were incubated with PBMCs for 4 days. Following incubation, PBMCs were stained with anti-CD4-PerCP/Cy5.5 (RPA-T4), anti-CD8-FITC (RPA-T8), anti-CD45RA–BV510 (HI100), anti-CD16-BV421 (3G8), anti-CD56-BV421 (HCD56), anti-CD27-PE (O323), and anti-Ki67-APC (Ki-67) to mark various cell populations and analyzed by FACS. Proliferation of NK cells, CD4+ T cells, and CD8+ T cells as indicated by Ki67 expression are depicted in FIGS. 36A-36C. Each of the IL-15/Rα-Fc fusion proteins and the IL-15 control induced strong proliferation of NK cells, CD8+ T cells, and CD4+ T cells.

1C: IL-15/Rα-Fc Fusion Proteins Engineered for Lower Potency and Increased PK and Half-Life In order to further improve PK and prolong half-life, it was reasoned that decreasing the potency of IL-15 would decrease the antigen sink, and thus, increase the half-life. By examining the crystal structure of the IL-15:IL-2Rβ and IL-15:common gamma chain interfaces, as well as by modeling using MOE software, it was predicted that residues at these interfaces may be substituted in order to reduce potency. FIG. 37 depicts a structural model of the IL-15:receptor complexes showing locations of the predicted residues where isosteric substitutions (in order to reduce the risk of immunogenicity) were engineered. Sequences for illustrative IL-15 variants designed for reduced potency are depicted in FIG. 3.

Plasmids coding for IL-15 or IL-15Rα(sushi) were constructed by standard gene synthesis, followed by subcloning into a pTT5 expression vector containing Fc fusion partners (e.g., constant regions as depicted in FIGS. 8A-8D). Substitutions identified as described above were incorporated by standard mutagenesis techniques. Sequences for illustrative IL-15/Rα-Fc fusion proteins of the "IL-15/Rα-heteroFc" format engineered for reduced potency are depicted in FIGS. 39A-39E. Sequences for illustrative IL-15/Rα-Fc fusion proteins of the "scIL-15/Rα-Fc" format engineered for reduced potency are depicted in FIGS. 40A-40D. Sequences for illustrative IL-15/Rα-Fc fusion proteins of the "ncIL-15/Rα-Fc" format engineered for reduced potency are depicted in FIGS. 41A-41B. Sequences for illustrative ncIL-15/Rα heterodimers engineered for reduced potency are depicted in FIG. 42. Sequences for an illustrative IL-15/Rα-Fc fusion protein of the "bivalent ncIL-15/Rα-Fc" format engineered for reduced potency are depicted in FIG. 43. Sequences for illustrative IL-15/Rα-Fc fusion proteins of the "dsIL-15/Rα-Fc" format engineered for reduced potency are depicted in FIG. 44.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

1C(a): In Vitro Activity of Variant IL-15/Rα-Fc Fusion Proteins Engineered for Decreased Potency The variant IL-15/Rα-Fc fusion proteins were tested in a number of cell proliferation assays.

In a first cell proliferation assay, IL-15/Rα-Fc fusion proteins (with or without engineered substitutions) or control were incubated with PBMCs for 4 days. Following incubation, PBMCs were stained with anti-CD4-Evolve605 (SK-3), anti-CD8-PerCP/Cy5.5 (RPA-T8), anti-CD45RA-APC/Cy7 (HI100), anti-CD16-eFluor450 (CB16), anti-CD56-eFluor450 (TULY56), anti-CD3-FITC (OKT3), and anti-Ki67-APC (Ki-67) to mark various cell populations and analyzed by FACS. Proliferation of NK cells, $CD8^+$ T cells, and CD4+ T cells as indicated by Ki67 expression are depicted in FIGS. 45-46. Most of the IL-15/Rα-Fc fusion proteins induced proliferation of each cell population; however, activity varied depending on the particular engineered substitutions.

In a second cell proliferation assay, IL-15/Rα-Fc fusion proteins (with or without engineered substitutions) were incubated with PBMCs for 3 days. Following incubation, PBMCs were stained with anti-CD3-FITC (OKT3), anti-CD4-Evolve604 (SK-3), anti-CD8-PerCP/Cy5.5 (RPA-T8), anti-CD16-eFluor450 (CB16), anti-CD56-eFluor450 (TULY56), anti-CD27-PE (O323), anti-CD45RA-APC/Cy7 (HI100) and anti-Ki67-APC (20Raj1) antibodies to mark various cell populations. Lymphocytes were first gated on the basis of side scatter (SSC) and forward scatter (FSC). Lymphocytes were then gated based on CD3 expression. Cells negative for CD3 expression were further gated based on CD16 expression to identify NK cells (CD16+). CD3+ T cells were further gated based on CD4 and CD8 expression to identify CD4+ T cells, CD8+ T cells, and γδ T cells (CD3+CD4−CD8−). The CD4+ and CD8+ T cells were gated for CD45RA expression. Finally, the proliferation of the various cell populations was determined based on percentage Ki67 expression, and the data are shown in FIGS. 47A-D. NK and CD8+ T cells are more sensitive than CD4+ T cells to IL-15/Rα-Fc fusion proteins, and as above, proliferative activity varied depending on the particular engineered substitutions. FIG. 47D shows the fold change in EC50 of various IL-15/Rα-Fc fusion proteins relative to control XENP20818. FIGS. 48A and 48B further depict the activation of lymphocytes following treatment with IL-15/Rα-Fc fusion proteins by gating for the expression of CD69 and CD25 (T cell activation markers) before and after incubation of PBMCs with XENP22821.

In a third experiment, additional variant IL-15/Rα-Fc fusion proteins were incubated with human PBMCs for 3 days at 37° C. Following incubation, PBMCs were stained with anti-CD3-FITC (OKT3), anti-CD4-SB600 (SK-3), anti-CD8-PerCP/Cy5.5 (RPA-T8), anti-CD45RA-APC/Cy7 (HI100), anti-CD16-eFluor450 (CB16), anti-CD25-PE (M-A251), and anti-Ki67-APC (Ki-67) to mark various cell populations and analyzed by FACS. Proliferation of CD8+ (CD45RA−) T cells, CD4+(CD45RA−) T cells, γδ T cells, and NK cells as indicated by Ki67 expression are depicted in FIGS. 49A-49D.

In a fourth experiment, human PBMCs were incubated with the additional IL-15/Rα-Fc variants at the indicated concentrations for 3 days. Following incubation, PBMCs were stained with anti-CD3-FITC (OKT3), anti-CD4 (SB600), anti-CD8-PerCP/Cy5.5 (RPA-T8), anti-CD16-eFluor450 (CB16), anti-CD25-PE (M-A251), anti- CD45RA-APC/Cy7 (HI100), and anti-Ki67-APC (Ki67) and analyzed by FACS. Percentage of Ki67 on CD8+ T cells, CD4+ T cells and NK cells following treatment are depicted in FIG. 50.

In a fifth experiment, variant IL-15/Rα-Fc fusion proteins were incubated with human PBMCs for 3 days at 37° C. Following incubation, cells were stained with anti-CD3-PE (OKT3), anti-CD4-FITC (RPA-T4), anti-CD8α-BV510 (SK1), anti-CD8β-APC (2ST8.5H7), anti-CD16-BV421 (3G8), anti-CD25-PerCP/Cy5.5 (M-A251), anti-CD45RA-APC/Cy7 (HI100), anti-CD56-BV605 (NCAM16.2), and anti-Ki67-PE/Cy7 (Ki-67) and analyzed by FACS. Percentage of Ki67 on CD8+ T cells, CD4+ T cells, γδ T cells, and NK cells are depicted in FIGS. 51A-51E.

In a sixth experiment, variant IL-15/Rα-Fc fusion proteins were incubated with human PBMCs for 3 days at 37° C. Following incubation, cells were stained with anti-CD3-PE (OKT3), anti-CD4-FITC (RPA-T4), anti-CD8α-BV510 (SK1), anti-CD8β-APC (SIDI8BEE), anti-CD16-BV421 (3G8), anti-CD25-PerCP/Cy5.5 (M-A251), anti-CD45RA-APC/Cy7 (HI100), anti-CD56-BV605 (NCAM16.2), and anti-Ki67-PE/Cy7 (Ki-67) and analyzed by FACS. Percentage of Ki67 on CD8+ T cells, CD4+ T cells, γδ T cells, and NK cells are depicted in FIGS. 52A-52E.

In a seventh experiment, variant IL-15/Rα-Fc fusion proteins were incubated with human PBMCs at the indicated concentrations for 3 days at 37° C. Following incubation, PBMCs were stained with anti-CD3-PE (OKT3), anti-CD4-FITC (RPA-T4), anti-CD8-APC (RPA-T8), anti-CD16-BV605 (3G8), anti-CD25-PerCP/Cy5.5 (M-A251), anti-CD45RA- APC/Fire750 (HI100) and anti-Ki67-PE/Cy7 (Ki-67) and analyzed by FACS. Percentage Ki67 on CD8+ T cells, CD4+ T cells, γδ T cells and NK (CD16+) cells are depicted in FIGS. 53A-D. The data show that the ncIL-15/Rα-Fc fusion protein XENP21479 is the most potent inducer of CD8+ T cell, CD4+ T cell, NK (CD16+) cell, and γδ T cell proliferation. Each of the scIL-15/Rα-Fc fusion proteins were less potent than XENP21479 in inducing proliferation, but differences were dependent on both the linker length, as well as the particular engineered substitutions.

In an eighth experiment, variant IL-15/Rα-Fc fusion proteins were incubated with human PBMCs at the indicated concentrations for 3 days at 37° C. Following incubation, PBMCs were stained with anti-CD3-PE (OKT3), anti-CD4-FITC (RPA-T4), anti-CD8-APC (RPA-T8), anti-CD16-BV605 (3G8), anti-CD25-PerCP/Cy5.5 (M-A251), anti-CD45RA- APC/Fire750 (HI100) and anti-Ki67-PE/Cy7 (Ki-67) and analyzed by FACS. Percentage Ki67 on CD8+ T cells, CD4+ T cells, γδ T cells and NK (CD16+) cells are respectively depicted in FIGS. 54A-D. As above, the data show that the ncIL-15/Rα-Fc fusion protein XENP21479 is the most potent inducer of CD8+ T cell, CD4+ T cell, NK (CD16+) cell, and γδ T cell proliferation. Notably, introduction of Q108E substitution into the ncIL-15/Rα-Fc format (XENP24349) drastically reduces its proliferative activity in comparison to wildtype (XENP21479).

1C(b): PK of IL-15/Rα-Fc Fusion Proteins Engineered for Reduced Potency

In order to investigate if IL-15/Rα-Fc fusion proteins engineered for reduced potency had improved half-life and PK, these variants were examined in a PK study in C57BL/6 mice. Two cohorts of mice (5 mice per test article per cohort) were dosed with 0.1 mg/kg of the indicated test articles via IV-TV on Day 0. Serum was collected 60 minutes after dosing and then on Days 2, 4, and 7 for Cohort 1 and Days 1, 3, and 8 for Cohort 2. Serum levels of IL-15/Rα-Fc fusion proteins were determined using anti-IL-15 and anti-IL-15Rα antibodies in a sandwich ELISA. The results are depicted in FIG. 55. FIG. 56 depicts the correlation between potency and half-life of the test articles. As predicted, variants with reduced potency demonstrated substantially longer half-life. Notably, half-life was improved up to almost 9 days (see XENP22821 and XENP22822), as compared to 0.5 days for the wild-type control XENP20818.

Example 2: Engineering NKG2A and NKG2D-Targeted IL-15/Rα-Fc Fusions

One strategy by which tumors escape immune elimination is through downregulation of MHC class I in order to avoid recognition by T cells (Garrido, F et al., 2016). As a backup, NK cells can recognize cancer cells in the absence of MHC I, and in fact, may be sensitized the downregulation of MHC class I by tumor cells (Zamai, L et al., 2007). However, cancer patients have been found with reduced NK cell counts (Levy, E M et al., 2011). Accordingly, NKG2A and NKG2D-targeted constructs were generated with the aim to not only skew the IL-15/Rα-Fc fusions away from Tregs, but to also selectively target and expand NK cells.

2A: Engineering NKG2A and NKG2D-Targeted IL-15/Rα-Fc Fusions

The VH and VL sequences of monalizumab (as disclosed in U.S. Pat. No. 8,901,283, issued Dec. 2, 2014) was humanized and engineered in the Fab format for use as a component of proof of concept NKG2A-targeted IL-15/Rα-Fc fusions. The sequences for monalizumab (chimeric and humanized) in bivalent format are depicted in FIG. 58 as XENP24541 and XENP24542.

The VH and VL sequences of an anti-NKG2D (as disclosed in U.S. Pat. No. 7,879,985, issued Feb. 1, 2011) was engineered in the Fab format for use as a component of prototype NKG2D-targeted IL-15/Rα-Fc fusion. The sequence in bivalent mAb format is depicted in FIG. 59 as XENP24365.

NKG2A and NKG2D-targeted IL-15/Rα-Fc fusions were generated in the scIL-15/Rα×Fab format as depicted in FIG. 57D, which comprises a VH fused to the N-terminus of a heterodimeric Fc-region, with the other side comprising IL-15Rα(sushi) fused to IL-15 by a variable length linker (termed "scIL-15/Rα") fused to the N-terminus of the other side of the heterodimeric Fc-region, while a corresponding light chain is transfected separately as to form a Fab with the VH. Sequences for illustrative NKG2A-targeted IL-15/Rα-Fc fusions XENP24531, XENP24532 and XENP27146 are depicted in FIG. 60, and sequences for illustrative NKG2D-targeted IL-15/Rα-Fc fusions XENP24533, XENP24534, and XENP27145 are depicted in FIGS. 61A-61B.

Plasmids coding for the VH and VL sequences as described above, IL-15 and IL-15Rα(sushi) domains, light chain constant region, and heterodimeric constant regions (as depicted in FIG. 9) were constructed by Gibson assembly. Proteins were produced by transient transfection in HEK293E cells and were purified by a two-step purification process comprising Protein A chromatography followed by ion exchange chromatography.

2B: Activity of NKG2A-Targeted IL-15/Rα-Fc Fusions with IL-15 Potency Variants

A one-arm scIL-15/Rα Fc fusion (XENP21993), NKG2A-targeted reduced potency scIL-15(N65D)/Rα (XENP24531), and NKG2A-targeted reduced potency scIL-15(Q108E)/Rα (XENP24532) which have anti-NKG2A Fab arms based on monalizumab were tested in a cell proliferation assay.

Human PBMCs were treated with the test articles at the indicated concentration. 3 days after treatment, the PBMCs were analyzed by FACS. Percentage of Ki67 on CD4+ T cells, CD8+ T cells, and NK cells are depicted in FIGS. 62A-C for each test article. The data show that in comparison to XENP21993, XENP24531 and XENP24532 demonstrated decreased potency in proliferating CD4+ T cells, CD8+ T cells, and NK cells. Notably, XENP24532 demonstrated decreased efficacy in proliferating CD4+ T cells while maintaining efficacy in proliferating CD8+ T cells, in comparison to XENP24531. This suggests that even with the same NKG2A-targeting Fab arm, the potency of the scIL-15/Rα side impacts the potency in expanding various cell types.

2C: NKG2A and NKG2D-Targeted Reduced-Potency IL-15/Rα-Fc Fusions Show Selective Proliferation of NK Cells Human PBMCs were treated with the test articles at the indicated concentrations. 3 days after treatment, the PBMCs were first stained with anti-CD3-PerCP/Cy5.5 (OKT3), anti-CD4-BV786 (RPA-T4), anti-CD8-PE/Cy7 (SIDI8BEE), anti-CD16-BV421 (3G8), anti-CD56-BV605, and anti-CD45RA-APC/Cy7 (HI100). Cells were washed again and stained with anti-FoxP3-AF488 (259D) and anti-Ki67-APC using eBioscience™ Foxp3/Transcription Factor Staining Buffer Set (Thermo Fisher Scientific, Waltham, Mass.). Lymphocytes were first identified by gating on the basis of SSC and FSC. The lymphocytes were then gated based on CD3 expression to identify NK cells (CD3-CD16+) and CD3+ T cells. The CD3+ T cells were then gated based on CD4 and CD8 to identify CD4+ and CD8+ T cells. CD4+ and CD8+ memory T cell subpopulations were then identified by further gating based on CD45RA. Finally, percentage of Ki67, a protein strictly associated with cell proliferation, on CD4+ T cells (CD3+CD4+CD45RA−), CD8+ T cells (CD3+CD8+CD45RA−), and NK cells was determined (depicted respectively in FIGS. 63A-C). The data show that the control "RSV-targeted" reduced-potency one-arm scIL-15 (N4D/N65D)/Rα-Fc XENP26007 has significantly reduced potency in proliferation of CD8+ and CD4+ T cells as well as NK cells, in comparison to XENP20818 (WT IL-15/Rα-Fc). Targeting with anti-NKG2A or anti-NKG2D Fab arms (as in XENP27145 and XENP27146) selectively induces proliferation of NK cells with no increase in potency on proliferating CD8+ and CD4+ T cells.

Following binding of cytokines to their receptors, Janus kinases (JAKs) associated with the receptors phosphorylate STAT proteins which then translocate into the nucleus to regulate further downstream processes. Therefore, phosphorylation of STAT proteins (in particular, STAT5, which include STAT5a and STAT5b) is one of the earliest signaling events triggered by IL-15 binding to its receptors.

Accordingly, in another experiment, induction of STAT5 phosphorylation was investigated on various lymphocyte populations by the NKG2A and NKG2D-targeted IL-15/Rα-Fc fusions. Human PBMCs were incubated with the following test articles at the indicated concentrations for 15 minutes at 37° C.: XENP20818 (WT IL-15/Rα-Fc), XENP24050, XENP27145, and XENP27146. To gate for various cell populations following incubation, PBMCs were stained with anti-CD3-BUV395 (UCHT1), anti-CD4-BV605 (RPA-T4), and anti-CD8-Alexa700 (SK1) for 30-45 minutes at room temperature. Cells were washed and incubated with pre-chilled (−20° C.) 90% methanol for 20-60 minutes. After methanol incubation, cells were washed again and stained with anti-CD25-BV421 (M-A251), anti-CD45RA–BV510 (HI100), anti-FoxP3-AF488 (249D), anti-CD56-PE, and anti-pSTAT5-Alexa647 (pY687) to mark various cell populations and STAT5 phosphorylation. Data depicting induction of STAT5 phosphorylation on CD8+ T cell, CD4+ T cell, Treg, and NK cell populations are depicted in FIG. 64. Consistent with the above data depicting Ki67 expression, the data here show that XENP26007 has significantly reduced potency in inducing STAT5 phosphorylation on CD8+ and CD4+ T cells as well as Tregs and NK cells in comparison to XENP20818, and targeting with anti-NKG2A or anti-NKG2D Fabs (as in XENP27145 and XENP27146) selectively targets NK cells while showing no preferred targeting of CD8+ T cells, CD4+ T cells, or Tregs.

Example 3: CD8-Targeted IL-15/Rα-Fc Fusion

3A: Engineering CD8-Targeted IL-15/Rα-Fc Fusions

The parental variable region of a murine anti-CD8 antibody (depicted in FIG. 65 as XENP15076) was humanized (as previously described in U.S. Pat. No. 7,657,380, issued Feb. 2, 2010) and engineered in the Fab format for use as component of prototype CD8-targeted IL-15/Rα-Fc fusion. The sequences for the humanized anti-CD8 is depicted in FIG. 65 as a bivalent antibody (XENP15251) and Fab (XENP23647), as well as a humanized variant as a one-arm mAb (XENP24317).

CD8-targeted IL-15/Rα-Fc fusions were generated in the scIL-15/RαxFab format as depicted in FIG. 57D, which comprises IL-15Rα(sushi) fused to IL-15 by a variable length linker (termed "scIL-15/Rα") which is then fused to the N-terminus of a heterodimeric Fc-region, with a variable heavy chain (VH) fused to the other side of the heterodimeric Fc, while a corresponding light chain is transfected separately so as to form a Fab with the VH. Illustrative CD8-targeted IL-15/Rα-Fc fusions in this format include XENP24114, XENP24115, and XENP24116, sequences for which are depicted in FIG. 66.

CD8-targeted IL-15/Rα-Fc fusions were also generated in the following formats: the FabxncIL-15/Rα format as depicted in FIG. 57E, which comprises a VH fused to the N-terminus of a heterodimeric Fc-region, with IL-15Rα (sushi) fused to the other side of the heterodimeric Fc, while a corresponding light chain is transfected separately so as to form a Fab with the VH, and while IL-15 is transfected separately so that a non-covalent IL-15/Rα complex is formed; the mAb-scIL-15/Rα format as depicted in FIG. 57G, which comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form a Fabs with the VHs; the mAb-ncIL-15/Rα format as depicted in FIG. 57H, which comprises VH fused to the N-terminus of a first and a second heterodimeric Fc, with IL-15Rα (sushi) fused to the C-terminus of one of the heterodimeric Fc-region, while corresponding light chains are transfected separately so as to form a Fabs with the VHs, and while and while IL-15 is transfected separately so that a non-covalent IL-15/Rα complex is formed; the central-IL-15/Rα as depicted in FIG. 57J, which comprises a VH recombinantly fused to the N-terminus of IL-15 which is then further fused to one side of a heterodimeric Fc and a VH recombinantly fused to the N-terminus of IL-15Rα(sushi) which is then further fused to the other side of the heterodimeric Fc, while corresponding light chains are transfected separately so as to form a Fabs with the VHs; and the central-scIL-15/Rα format as depicted in FIG. 57K, which comprises a VH fused to the N-terminus of IL-15Rα(sushi) which is fused to IL-15 which is then further fused to one side of a heterodimeric Fc and a VH fused to the other side of the heterodimeric Fc, while corresponding light chains are transfected separately so as to form a Fabs with the VHs. Illustrative sequences for CD8-targeted IL-15/Rα-Fc fusions of these alternative formats are depicted in FIG. 79.

Plasmids coding for the VH and VL sequences as described above, IL-15 and IL-15Rα(sushi) domains, light chain constant region, and heterodimeric constant regions (as depicted in FIG. 9) were constructed by Gibson assembly. Proteins were produced by transient transfection in HEK293E cells and were purified by a two-step purification process comprising Protein A chromatography followed by ion exchange chromatography.

3B: Induction of Cell Proliferation by a CD8-Targeted IL-15 Fc Fusion Prototype

A bivalent anti-CD8 antibody (XENP15251), one-arm scIL-15/Rα-Fc fusion (XENP21993), CD8-targeted scIL-15/Rα-Fc (XENP24114) which has an anti-CD8 Fab arm based on XENP15251 were tested in a cell proliferation assay.

Human PBMCs were treated with the test articles at the indicated concentrations. 3 days after treatment, the PBMCs were stained with anti-CD3-PE (OKT3), anti-CD4-FITC (RPA-T4), anti-CD8-APC (RPA-T8), anti-CD16-BV605 (3G8), anti-CD45RA-APC/Fire750 (HI100) and anti-Ki67-PE/Cy7 (Ki-67) and analyzed by FACS. Lymphocytes were first identified by gating on the basis of SSC and FSC. The lymphocytes were then gated based on CD3 expression to identify NK cells (CD3−CD16+) and CD3+ T cells. The CD3+ T cells were then gated based on CD4 and CD8 to identify CD4+, CD8+ and γδ T cells (CD3+CD4−CD8−). CD4+ and CD8+ memory T cell subpopulations were then identified by further gating based on CD45RA. Finally, percentage of Ki67, a protein strictly associated with cell proliferation, on CD4+ T cells (CD3+CD4+CD45RA−), CD8+ T cells (CD3+CD8+CD45RA−), and NK cells was determined (depicted respectively in FIGS. 67A-C). The data show that the CD8-targeted IL-15/Rα-Fc fusion was more potent at inducing CD8+ T cell proliferation than the one-armed IL-15/Rα-Fc fusion. Notably, the CD8-targeted IL-15/Rα-Fc fusion was less potent at inducing CD4+ T cell proliferation than the one-armed IL-15/Rα-Fc fusion, due to weakened IL-15 activity resulting from inclusion of a Fab arm.

3C: Induction of Cell Proliferation by a CD8-Targeted Reduced-Potency IL-15 Fc Fusion Prototype One-arm scIL-15/Rα Fc fusion (XENP21993), one-arm reduced potency scIL-15/Rα Fc fusion (XENP24014) and CD8-targeted reduced potency scIL-15/Rα-Fc fusions (XENP24116) which has an anti-CD8 Fab arm based on XENP15251 were tested in a cell proliferation assay. Human PBMCs were treated with the test articles at the indicated concentration. 3 days after treatment, the PBMCs were analyzed by FACS. Percentage of Ki67 on CD4+ T cells, CD8+ T cells, and NK cells are depicted in FIGS. 68A-68C.

The data show that in comparison to XENP21993, XENP24014 demonstrated decreased potency in proliferating NK cells, CD4+ T cells, and CD8+ T cells. In comparison to XENP24014, XENP24116 demonstrated increased potency in proliferating CD8+ T cells (comparable to XENP21993), reduced potency on CD4+ T cells, and similar potency on NK cells.

3D: Effect of CD8-Targeted Reduced-Potency IL-15 Fc Fusion Prototype on Tregs

The effect of CD8-targeted reduced potency scIL-15(N65D)/Rα-Fc (XENP24116), as well as one-arm reduced potency scIL-15(N65D)/Rα Fc fusion (XENP24014), reduced potency IL-15(Q108E)/Rα-Fc heterodimer (XENP22822) and recombinant human IL-15 (rhIL-15), on Treg proliferation (as indicated by percentage Ki67 expression on CD4+ T cells) was investigated.

In vitro rapamycin expanded Tregs were used to investigate the effect of CD8-targeted IL-15/Rα-Fc fusions. It has been previously reported that rapamycin promotes proliferation of CD4+CD25+FOXP3+ T regs in vitro, and resulting expanded Tregs suppress CD4+ and CD8+ T cell proliferation (see, for example, Battaglia et al. (2006) Rapamycin promotes expansion of functional CD4+CD25+FOXP3+ regulatory T cells of both healthy subjects and type 1 diabetic patients. J Immunol. 177(12) 8338-8347; and Strauss et al. (2007) Selective survival of naturally occurring human CD4+CD25+Foxp3+ regulatory T cells cultured with rapamycin. J Immunol. 178(1) 320-329). Accordingly, CD4+ T cells were enriched from human PBMCs from two donors (Donor 21 and 23) by negative selection using EasySep™ Human CD4+ T Cell Enrichment Kit (STEMCELL Technologies, Vancouver, Canada). Treg were expanded using Dynabeads™ Human Treg Expander (Thermo Fisher Scientific, Waltham, Mass.) in RPMI1640+ 10% fetal bovine serum+0.1 µg/ml rapamycin+500 U/ml IL-2 for 1-4 days. Tregs were transferred to T75 flasks coated with 0.5 µg/ml anti-CD3 (OKT3, Biolegend, San Diego, Calif.) and cultured with RPMI1640+10% fetal bovine serum+0.1 µg/ml rapamycin+100 U/ml IL-2+0.5 µg/ml anti-CD28 mAb. Experiments were performed at least 8 days after initial enrichment of CD4+ T cells from PBMCs. $1.5 \times 10^5$ rapamycin cultured Tregs were incubated with indicated concentration of the indicated test articles for 4 days on anti-CD3 coated plates (0.5 µg/mL OKT3) at 37° C. On day 4, cells were analyzed by FACS. Percentage of Ki67 on CD4+ T are depicted in FIG. 69A-69B respectively for donors 21 and 23. CD4+ cell counts are depicted in FIG. 70A-B respectively for donors 21 and 23. CD25 MFI are depicted in FIGS. 71A-B respectively for donors 21 and 23.

The data show that recombinant human IL-15 induces the most robust Treg proliferation. While XENP22822 and XENP24014 induce less Treg proliferation compared to rhIL-15, the CD8-targeted reduced potency scIL-15(N65D)/Rα-Fc fusion XENP24116 is the weakest inducer of Treg proliferation.

3E: Induction of CD8+ T Cell Proliferation by CD8-Targeted Reduced-Potency IL-15 Fc Fusion in a Suppression Assay The effect of CD8-targeted reduced potency scIL-15 (N61D)/Rα-Fc fusion (XENP24115), as well as one-arm reduced potency scIL-15(N61D)/Rα Fc fusion (XENP24013), on CD8+ responder T cell, CD4+ responder T cell, and NK cell proliferation in the presence of Tregs was investigated.

CFSE labeled PBMCs were incubated with 500 ng/mL of indicated test articles and indicated concentration of Tag-it Violet labeled Tregs (expanded as described in Example 2C) on anti-CD3 coated plates (OKT3; 100 ng/mL). After 4 days incubation at 37° C., cells were analyzed by FACS, and proliferation was measured by CFSE. The data is depicted in FIG. 72A-72C respectively for percentage proliferating CD8 T cell, CD4 T cell and NK cell. FIG. 73 depicts the Treg counts in a similar experiment using different Tregs:PBMC ratios.

The data show that the CD8-targeted IL-15/Rα-Fc fusions increases CD8+ responder T cell proliferation, and more Tregs were needed to suppress proliferation. The data also show that neither XENP24115 nor XENP24013 affected CD4+ responder T cell proliferation; however, both induced NK cell proliferation. Notably, FIG. 73 shows that while the CD8-targeted IL-15/Rα-Fc fusion still induces proliferation of Tregs (in comparison to control with no treatment), the induction is substantially less than that resulting from treatment with one-arm scIL-15/Rα-Fc.

In a further experiment, the dose response for proliferation of CD8+ memory T cell, CD4+ memory T cell and Tregs following treatment with CD8-targeted IL-15/Rα-Fc fusions in the presence of Tregs was investigated. 1×105 CFSE labeled PBMCs and 5×104 Tag-it Violet labeled Tregs (expanded as described in Example 3D; 1:2 Treg:PBMC ratio) were incubated with indicated concentrations of indicated test articles including anti-RSV bivalent mAb (XENP15074) as control for 4 days on anti-CD3 coated plates (OKT3; 100 ng/mL). Proliferation was measured by CFSE or Tag-it Violet dilution. The data is depicted in FIG. 74A-74C, respectively for CD8+ memory T cells, CD4+ memory T cells and Tregs. Finally, the dose response for proliferation of Tregs in the absence of PBMCs following treatment with CD8-targeted IL-15/Rα-Fc fusion was investigated. 1×105 Tag-it Violet labeled Tregs were incubated with indicated concentrations of indicated test articles for 4 days on anti-CD3 coated plages (OKT3; 100 ng/mL). Cell counts as depicted in FIG. 75 was measured by Tag-it Violet dilution.

The data show that the CD8-targeted IL-15/Rα-Fc fusion induced greater proliferation of CD8+ memory T cells than the one-arm scIL-15/Rα-Fc at all concentrations tested. Notably, the CD8-targeted IL-15/Rα-Fc fusion induces less proliferation of CD4+ memory T cells and Tregs than the one-arm scIL-15/Rα-Fc.

3F: Activity of a Prototype CD8-Targeted Reduced-Potency IL-15 Fc Fusion in a GVHD Model CD8-targeted reduced potency IL-15/Rα-Fc fusion (XENP24116) and additional reduced potency IL-15 variants were evaluated in a Graft-versus-Host Disease (GVHD) model conducted in female NSG (NOD-SCID-gamma) immunodeficient mice. When the NSG mice were injected with human PBMCs, the human PBMCs developed an autoimmune response against mouse cells. Treatment of NSG mice injected with human PBMCs followed with CD8-targeted IL-15/Rα-Fc fusion and IL-15 variants enhance proliferation of the engrafted T cells.

10 million human PBMCs were engrafted into NSG mice via IV-OSP on Day −7 followed by dosing with the indicated test articles (0.3 mg/kg) on Day 0. Whole blood was collected on Days 4 and 7, and mice were sacrificed on Day 11 for their spleens to measure CD4+ and CD8+ T cell counts using FACS. FIG. 76A-76D respectively depict CD4+ T cell events, CD8+ T cell events, correlation between CD8+ T cell and CD4+ T cell events and CD8+ T cell/CD4+ T cell ratio in whole blood on Day 4. FIG. 77A-77D respectively depict CD4+ T cell events, CD8 T cell events, correlation between CD8+ T cell and CD4+ T cell events and CD8+ T cell/CD4+ T cell ratio in whole blood on Day 7. FIG. 78A-78D respectively depict CD4+ T cell events, CD8 T cell events, correlation between CD8+ T cell and CD4+ T cell events and CD8+ T cell/CD4+ T cell ratio in spleen on Day 8. Each point represents one female NSG mouse. The data show that XENP24116 selectively expands CD8+ T cells in comparison to the IL-15 variants which expand both CD4+ and CD8+ T cells.

3G: Alternative Format CD8-Targeted IL-15 Fc Fusions

A number of alternative format CD8-targeted IL-15/Rα-Fc fusions as depicted in FIG. 57 (cartoon) and FIG. 79 (sequences) were tested in a cell proliferation assay. Human PBMCs were treated with XENP24114, XENP24116, XENP24546, XENP24543, XENP24547, and XENP24548. 3 days after treatment, the PBMCs were analyzed by FACS. Percentage of Ki67 on CD4+ T cells, CD8+ T cells, and NK cells are depicted in FIG. 80.

Example 4: CD8-Targeted IL-15/Rα-Fc Fusion (Non-Blocking CD8 Binding Domain)

4A: Phage Display Library and Screening of CD8 Binders

Recombinant human CD8a and cyno CD8α were generated in-house for phage panning. Plasmids coding for the antigens were constructed by Gibson assembly in a pTT5 vector. After transient transfection of HEK293E cells, the secreted antigens were purified via Protein A affinity chromatography.

In-house de novo phage libraries were built displaying Fab variants on phage coat protein pIII, and were panned in 4 rounds. Prior to the first round and after each round, phage were added to log-phase XL1-Blue cells (Agilent, Wilmington, Del.) and incubated overnight at 37° C., 250 rpm. Fab clones were sequenced for their VH and VL identity, from which plasmids were constructed by Gibson assembly and subcloned into a pTT5 expression vector containing the coding sequence for the IgG1 constant regions. DNA was transfected in HEK293E for expression and resulting bivalent mAbs were purified from the supernatant using protein A affinity chromatography. The amino acid sequence for exemplary clone 1C11B3 is depicted in FIG. 81 bivalent mAb (XENP24025) and one-arm mAb (XENP24321).

4B: Phage Display Library and Screening of CD8 Binders

Phage clone 1C11B3 reformatted as one-arm Fab-Fc antibody (respectively XENP24321) was tested for binding to CD4+ and CD8+ T cells. A one-arm Fab-Fc antibody (XENP24317; sequences depicted in FIG. 65) based on a variant of XENP15251 was used as control.

T cells purified from human PBMCs using EasySep™ Human T Cell Isolation Kit (STEMCELL Technologies, Vancouver, Canada) were incubated with the test articles at the indicated concentrations for 1 hour on ice. Cells were centrifuged to remove excess amounts of test articles, resuspended with anti-CD3-FITC (HIT3a), anti-CD4-PE (OKT4) and a secondary antibody conjugated with APC, and incubated for 45 minutes on ice. Cells were washed twice, resuspended with staining buffer and analyzed with FACS. FIG. 82 depicts the MFI on CD4+ and CD8+ T cells. The data showed that XENP24321 binding to CD8+ T cells was superior to that of XENP24317.

4B: Identifying an Anti-CD8 mAb that does not Block CD8 Interaction with pMHCI

Tumor cells present major histocompatibility complex class I molecules (MHCI) which display peptide fragments recognized by the TCR (specific for the peptide) and CD8 on CD8+ T cells (as depicted in FIG. 83A). The binding of CD8 to pMHCI triggers proliferation and activation of the T cells. An anti-CD8 antibody may bind an epitope on CD8 which positions it so that it blocks binding of pMHCI by CD8 thereby preventing activation of the CD8+ T cell (FIG. 83B). In order to preserve activation, it is necessary to use an anti-CD8 arm in the CD8-targeted IL-15/Rα-Fc fusion which does not block the CD8-MHCI interaction.

4C(a): MHC Tetramer Assay

An MHC tetramer assay was used to investigate whether the anti-CD8 mAb clones described above blocked CD8 interaction with pMHCI. ~200 k T cells specific for HLA-A2*0201 restricted CMV pp65 (NLVPMVATV) peptide (SEQ ID NO: 6) (Donor153 from Astarte Biologics, Bothell, Wash.) were pre-incubated with indicated test articles at the indicated concentrations on ice for 30 minutes. A control sample incubated without anti-CD8 antibody was also used. Following incubation, the samples were stained with iTAg Tetramer/PE-HLA2:01 CMV pp65 (NLVPMVATV) (SEQ ID NO: 6) (MBL, Woburn, Mass.), anti-CD3-BUV395 (UCTH-1) and anti-CD4-APC/Fire750 (OKT4) for 1.5 hour and analyzed by FACS. The cells were first gated based on CD3 and CD4 expression to identify CD8+ cells. Binding of the MHC tetramer on the CD3+ cells was measured as PE MFI. The data is depicted in FIG. 84 as fraction of binding relative to the control sample.

The data show that pre-incubation with commercial OKT8 mAb (Thermo Fisher Scientific, Waltham, Mass. and in-housed produced as XENP15075) enabled MHC tetramer binding comparable to that of the control sample, while pre-incubation with other commercial mAbs SK-1 (BioLegend, San Diego, Calif.), 32-M4 (Santa Cruz Biotechnology, Dallas, Tex.) and DK25 (Dako, Carpinteria, Calif.) decreased binding by 15-80% which is consistent with results reported by Clement et al. Pre-incubation with XENP15251 decreased MHC tetramer binding by over 50%. Notably, pre-incubation with XENP24025 (1C11B3) decreased MHC tetramer binding by ~4% suggesting that clone 1C11B3 is non-blocking.

4C(b): Cytokine Release Assay

As described above, binding of TCR and CD8 on CD8+ T cells to pMHCI activates the T cell leading to cytokine release. Therefore, it was also investigated whether the anti-CD8 mAb clones blocked CD8 interaction with pMHCI in a cytokine release assay.

T2 cells were loaded with 50 ng/ml HLA-A2*0201 restricted CMV pp65 (NLVPMVATV) peptide (SEQ ID NO: 6) overnight at room temperature. As a negative control, T2 cells were loaded with NY-ESO-1 peptide. After overnight loading, the T2 cells were treated with Mitomycin-C(Sigma-Aldrich, St. Louis, Mo.) for 30 minutes at 37° C. 50 k T cells specific for HLA-A2*0201 restricted CMV pp65 (NLVPMVATV) peptide (SEQ ID NO: 6) were pre-incubated with 100 µg/ml of the indicated test articles (in duplicates). 10 k peptide loaded T2 cells were then added to the samples and incubated for 18 hours at 37° C. Controls without anti-CD8 pre-incubation were as follows: A) T2 cells loaded with pp65 peptide incubated with CMV specific T cells, B) T2 cells loaded with NY-ESO-1 peptide incubated with CMV specific T cells, C) unloaded T2 cells incubated with CMV specific T cells, and D) CMV specific T cells alone. Supernatant were collected and analyzed with IFNγ MSD assay (Meso Scale Discovery, Rockville, Md.).

The data as depicted in FIG. 85 show that IFNγ release by CMV specific T cells pre-incubated with OKT8 and XENP24025 was comparable to IFNγ release by CMV specific T cells in the absence of anti-CD8 antibody pre-incubation, while a decrease in IFNγ release was observed in CMV specific T cells pre-incubated with commercial antibodies SK-1, 32-M4 and DK25 as well as XENP15251. Furthermore, IFNγ release by CMV specific T cells pre-incubated with XENP24025 was comparable to release by CMV specific T cells in the absence of anti-CD8 antibody pre-incubation. FIG. 86 depicts the correlation between IFNγ release and tetramer binding MFI.

4D: CD8-Targeted IL-15/Rα-Fc with 1C11B3 Selectively Induces Proliferation of CD8+ T Cells Over CD4+ T Cells Human PBMCs were treated with XENP24736 (CD8-targeted reduced potency IL-15(N4D/N65D)/Rα-Fc with 1C11B3; sequences depicted in FIG. 87), XENP24050 (one-arm reduced potency IL-15(N4D/N65D)/Rα-Fc), XENP24321 (one-arm anti-CD8 mAb based on 1C11B3), and XENP20818 (WT IL-15/Rα-Fc) at the indicated concentrations for 3 days at 37° C. Next, the PBMCs were stained with anti-CD3-PE (OKT3), anti-CD4-FITC (RPA-T4), anti-CD8α-BV510 (RPAT8 or SK1), anti-CD8β-eF660 (SIDI8BEE), anti-CD16-BV421 (3G8), anti-CD25-PerCP/Cy5.5 (M-A251), anti-CD45RA– APC/Fire750 (HI100), and anti-CD56-BV605 (5.1H1) for 45 minutes on ice. Following staining with the afore panel, cells were stained with anti-Ki67-PE/Cy7 (Ki-67) for 30 minutes at room temperature and analyzed by FACS for various cell populations and their expression of Ki67. Data depicting percentage of CD8+CD45RA– and CD4+CD45RA– T cells expressing Ki67 are depicted in FIG. 88. The data show that in comparison to one-arm reduced-potency IL15/Rα-Fc XENP24050, CD8-targeting with 1C11B3 enhances proliferation of CD8+ T cells.

Example 5: CD8-Targeted IL-15 Fc Fusion (OKT8-Based)

5A: Humanization of OKT8

Prior art anti-CD8 antibody OKT8 (variable region sequence depicted in FIG. 89 as OKT8_H0.1 and OKT8_L0.1) was engineered in the context of a Fab for use in CD8-targeting IL-15 molecules. OKT8 was humanized using string content optimization (see, e.g., U.S. Pat. No. 7,657,380, issued Feb. 2, 2010). Variable heavy and light chain sequences for illustrative humanized OKT8 clones are depicted in FIG. 89. As above, CD8-targeted IL-15/Rα-Fc fusions were produced using Gibson-constructed plasmids coding for the VH and VL sequences as described above along with coding sequence for heterodimeric constant regions (as depicted in FIG. 9). Proteins were produced by transient transfection in HEK293E cells and were purified by a two-step purification process comprising Protein A chromatography followed by ion exchange chromatography. Sequences for illustrative CD8-targeted IL-15/Rα-Fc fusions with anti-CD8 Fab arms based on murine or humanized OKT8 variable regions are depicted in FIG. 92.

5a(a): OKT-8 Based CD8-Targeted IL-15/Rα-Fc Fusions Selectively Proliferate CD8+ T Cells Over CD4+ T Cells Human PBMCs were treated with CD8-targeted reduced-potency IL-15/Rα-Fc (N4D/N65D double mutant and D30N/E64Q/N65D triple mutant) with CD8 binding domains based on murine OKT8 or two versions of humanized OKT8 (H1L1 and H2L1) at the indicated concentrations for 3 days at 37° C. Following treatment, the PBMCs were stained with anti-CD3-PE (OKT3), anti-CD4-FITC (RPA-T4), anti-CD8α-BV510 (RPAT8 or SK1), anti-CD8β-eF660 (SIDI8BEE), anti-CD16-BV421 (3G8), anti-CD25-PerCP/Cy5.5 (M-A251), anti-CD45RA-APC/Cy7 (HI100), and anti-CD56-BV605 (NCAM16.2) for 45 minutes on ice. Following staining with the panel, cells were stained with anti-Ki67-PE/Cy7 (Ki-67) for 30 minutes at room temperature and analyzed by FACS for various cell populations and their expression of Ki67. Data depicting percentage of CD8+CD45RA– and CD4+CD45RA– T cells expressing Ki67 are depicted in FIG. 93. The data show that each of the CD8-targeted IL-15/Rα-Fc fusions were selective for CD8+ T cells over CD4+ T cells in comparison to control XENP20818. Unexpectedly, XENP24917 (OKT8_H1L1) was less potent in inducing proliferation of CD8+ T cells in comparison to XENP24919 (murine OKT8). Notably, XENP24918 (which had alternate humanized OKT8_H2L1) had restored potency similar to that of XENP24917. In addition, while XENP25137 which had reduced potency IL-15/Rα-Fc with triple mutant and OKT H2L1 anti-CD8 Fab arm was more potent than XENP24918 in induction of CD8+ T cell proliferation, XENP25137 was also more potent than XENP24918 in induction of CD4+ T cell proliferation.

5A(b): OKT8-Based CD8-Targeted IL-15/Rα-Fc Fusion Proliferates T Cells and Enhances Cytokine Secretion In Vivo in PBMC-Engrafted NSG Mice 10 million human PBMCs were engrafted into NSG mice via IV-OSP on Day −8 followed by dosing with the indicated test articles at the indicated concentrations on Day 0. FIG. 94A-B respectively depict CD8+ and CD4+ T cell counts on Day 7. The data show that the CD8-targeted IL-15/Rα-Fc fusion selectively proliferates CD8+ T cells over CD4+ T cells, as indicated by the CD8+/CD4+ T cell ratio. Notably, the data show that the CD8+ T cell selectivity is due to targeting of the IL-15/Rα-Fc fusion rather than a combination of effect from IL-15/Rα-Fc fusion and anti-CD8 (as indicated by the combination of XENP24050 and XENP24920).

5B: Engineering OKT8 for Cynomolgus CD8 Affinity

For ease of clinical development, it is useful to assess various parameters of the CD8-targeted IL-15/Rα-Fc fusion proteins such as pharmacodynamics, pharmacokinetics, and toxicity in cynomolgus monkeys. However, one exemplary humanized OKT8 variant (H2L1) only had 200 nM KD affinity for cynomolgus CD8 in comparison to 12 nM KD affinity for human CD8. Accordingly, a library of variants based on OKT8_H2L1 (referred to hereon as HuCy OKT8) were engineered to have similar affinity to both human and cyno CD8. The library was constructed by site-directed mutagenesis (QuikChange, Stratagene, Cedar Creek, Tx.) or standard gene synthesis. Sequences for variant heavy variable regions and variant light variable regions are depicted in FIG. 95. One-arm mAbs based on the variant variable regions were generated with a heavy variable region attached to a heterodimeric Fc region and with the other side of the molecule being "Fc-only", and a light variable region attached to a constant light region. Illustrative sequences for such one-arm mAbs are depicted in FIG. 91.

Affinity of the one-arm mAbs based on HuCy OKT8 variants for human and cynomolgus CD8 were assessed on Octet, a BioLayer Interferometry (BLI)-based method. Experimental steps for Octet generally included the following: Immobilization (capture of ligand to a biosensor); Association (dipping of ligand-coated biosensors into wells containing serial dilutions of the analyte); and Dissociation (returning of biosensors to well containing buffer) in order to determine the affinity of the test articles. A reference well containing buffer alone was also included in the method for background correction during data processing. In particular, human or cynomolgus CD8 was captured and dipped in multiple concentrations of the OKT8 variants. The resulting dissociation constant ($K_D$), association rate ($k_a$), and dissociation rate (1(d) are depicted in FIG. 96. The data show that while a number of variants had improved affinity for cynomolgus CD8 in comparison to OKT H2L1, only several of the variants had similar affinity for both human and cynomolgus CD8.

5C: CD8-Targeted IL-15/Rα-Fc Fusions (HuCy OKT8) are Active in Proliferation of Human T Cells CD8-targeted IL-15/Rα-Fc fusions with anti-CD8 Fab arms based on HuCy OKT8 variable regions were produced as generally described in Example 5A, sequences for illustrative molecules are depicted in FIG. 97 and FIG. 102.

5C(a): CD8-Targeted IL-15/Rα-Fc Fusions with HuCy OKT8 are Active In Vitro

Human PBMCs were treated with CD8-targeted reduced potency IL-15/Rα-Fc with illustrative HuCy OKT8 binding domains and one-arm reduced potency IL-15/Rα-Fc XENP24050 (as control) at the indicated concentrations for 3 days at 37° C. Following treatment, the PBMCs were stained with anti-CD3-PE (OKT3), anti-CD4-FITC (RPA-T4), anti-CD8α-BV510 (SK1), anti-CD8β-PE/Cy7 (SIDI8BEE), anti-CD16-BV421 (3G8), anti-CD25-PerCP/Cy5.5 (M-A251), anti-CD45RA-APC/Cy7 (HI100), and anti-CD56-BV605 (NCAM16.2) for 45 minutes on ice. Following staining with the panel, cells were stained with anti-Ki67-PE/Cy7 (Ki-67) for 30 minutes at room temperature and analyzed by FACS for various cell populations and their expression of Ki67. Data depicting percentage of CD8+CD45RA− and CD4+CD45RA− T cells expressing Ki67 are depicted in FIG. 98. The data show that each of the CD8-targeted molecules (including those with HuCy OKT8 binding domains) were more potent at inducing proliferation of CD8+ T cells than XENP24050.

In another experiment, fresh PBMCs were incubated with the indicated test articles at the indicated concentrations for 15 minutes. Following incubation, PBMCs were stained with anti-CD3-BUV395 (UCHT1), anti-CD4-BV605 (RPA-T4), and anti-CD8-Alexa700 (SK1) for 30-45 minutes at room temperature. Cells were washed and incubated with pre-chilled (−20° C.) 90% methanol for 20-60 minutes. After methanol incubation, cells were washed again and stained with anti-CD25-BV421 (M-A251), anti-CD45RA–BV510 (HI100), anti-FOXP3-Alexa488 (259D), anti-CD56-PE, and anti-pSTAT5-Alexa647 (pY694) at room temperature for 1 hour to mark various cell populations and STAT5 phosphorylation. Lymphocytes were first gated on the basis of side scatter (SSC) and forward scatter (FSC). CD4+ T cells were then gated based on CD3 and CD4 expression. Subpopulations of CD4+ T cells were further gated based on CD45RA expression, as well as FoxP3 and CD25 expression for Tregs. CD8+ T cells were gated based on CD3 and CD8 expression, and subpopulations were further gated based on CD45RA expression. Data depicting STAT5 phosphorylation on CD8+CD45RA− and CD4+CD45RA− T cells are shown in FIG. 99. Consistent with the data above depicting percentage of cells expressing Ki67, the HuCy OKT8-based CD8-targeted IL-15/Rα-Fc fusions are selective for CD8+ T cells over CD4+ T cells.

5C(b): CD8-Targeted IL-15/Rα-Fc Fusions (HuCy OKT8) Selectively Expand CD8+ T Cells In Vivo in PBMC Engrafted NSG Mice 10 million human PBMCs were engrafted into NSG mice via IV-OSP on Day −8 followed by dosing with the indicated test articles at the indicated concentrations on Day 0. FIG. 100 depicts the CD45+ cell, CD8+ T cell, and CD4+ T cell counts (as well as CD8+/CD4+ T cell ratio) in mice blood on Day 7. The data show that CD8-targeted IL-15/Rα-Fc fusions with HuCy OKT8 had similar activity in expanding CD45+ cells and T cells as CD8-targeted IL-15/Rα-Fc with OKT8_H2L1. Importantly, the CD8-targeted IL-15/Rα-Fc fusions with HuCy OKT8 retained selective expansion of CD8+ T cells over CD4+ T cells.

5D: OKT8-Based CD8-Targeted IL-15/Rα-Fc Fusions are Active in Proliferation of Cynomolgus T Cells Next, it was investigated whether the above CD8-targeted IL-15/Rα-Fc fusion with HuCy OKT8 binding domains were able to proliferate cynomolgus monkey lymphocytes. Cyno PBMCs were incubated with the indicated test articles for 4 days. Following incubation, PBMCs were stained with anti-CD3-PE (OKT3), anti-CD4-FITC (RPA-T4), anti-CD8α-BV510 (SK1), anti-CD8β-PE/Cy7 (SIDI8BEE), anti-CD16-BV421 (3G8), anti-CD25-PerCP/Cy5.5 (M-A251), anti-CD45RA-APC/Cy7 (HI100), and anti-CD56-BV605 (NCAM16.2) for 45 minutes on ice. Following staining with the panel, cells were stained with anti-Ki67-APC (Ki-67) for 30 minutes at room temperature and analyzed by FACS for various cell populations and their expression of Ki67. Data depicting percentage of CD8+CD45RA− and CD4+CD45RA− T cells expressing Ki67 are depicted in FIG. 101. The data show that each of the CD8-targeted IL-15/Rα-Fc fusions was able to proliferate cynomolgus T cells. Consistent with the data depicted in Example 5A(a), the CD8-targeted molecules were selective for CD8+ T cells over CD4+ T cells.

Example 6: CD8-Targeted IL-15/Rα-Fc Fusions are Selective for CD8+ T Cells Over CD4+ T Cells and Tregs 6A: CD8-Targeted IL-15/Rα-Fc Fusions Selectively Expand CD8+ T Cells Over CD4+ T Cells and Tregs In Vitro Human PBMCs were incubated with indicated test articles for 2, 5, 10, 15, 30, 60, 180, and 360 minutes at 37° C. The timing was achieved by adding the test articles at different times so that all the reactions were stopped simultaneously. Following incubation, PBMCs were stained with anti-CD3-BUV395 (UCHT1), anti-CD4-BV605 (RPA-T4), and anti-CD8-Alexa700 (SK1) for 30-45 minutes at room temperature. Cells were washed and incubated with pre-chilled (−20° C.) 90% methanol for 20-60 minutes. After methanol incubation, cells were washed again and stained with anti-CD25-BV510 (M-A251), anti-CD45RA-BV510 (HI100), anti-FOXP3-Alexa488 (259D), and anti-pSTAT5-Alexa647 to mark various cell populations and STAT5 phosphorylation. Lymphocytes were first gated on the basis of side scatter (SSC) and forward scatter (FSC). CD4+ T cells were then gated based on CD3 and CD4 expression. Subpopulations of CD4+ T cells were further gated based on CD45RA expression, as well as FoxP3 and CD25 expression for Tregs. CD8+ T cells were gated based on CD3 and CD8 expression, and subpopulations were further gated based on CD45RA expression. Data depicting STAT5 phosphorylation on the various populations are depicted in FIG. 103. The data show that CD8-targeted IL-15/Rα-Fc fusions activated CD8+ T cells while avoiding CD4+ T cells, including Tregs, demonstrating that the CD8-targeted molecules were selective for CD8+ T cells in comparison to WT IL-15 as well as IL-15/Rα-Fc fusions. Notably, much higher concentrations of the CD8-targeted IL-15/Rα-Fc (XENP26585) stimulated baseline levels of STAT5 phosphorylation in CD4+ T cells and Tregs in comparison to recombinant IL-15 and WT IL-15/Rα-Fc fusions XENP20818.

6B: CD8-Targeted IL-15/Rα-Fc Fusions Selectively Expand CD8+ T Cells Over CD4+ T Cells in Cynomolgus Monkeys Next, the in vivo effect of the CD8-targeted IL-15/Rα-Fc fusions was investigated in expanding T cells in cynomolgus monkeys. Cynomolgus (3 animals per group) were dosed with the indicated test articles on Day 0 and monitored for 3 weeks. Data depicting fold change in CD8+ T cell and CD4+ T cell are depicted in FIG. 104. Data depicting the percentage of CD4+CD45RA− and CD8+CD45RA− T cells in peripheral blood positive for Ki67 expression are depicted in FIG. 105. Data depicting the percentage of Ki67 on CD8+CD45RA− T cells in lymph nodes are depicted in FIG. 106. Consistent with in vitro data on expansion of cynomolgus PBMCs as depicted in Example 5D as well as in vivo data on expansion of human PBMCs in PBMC-engrafted mice, the data here show that the CD8-targeted IL-15/Rα-Fc fusions selectively expand CD8+ T cells over CD4+ T cells Example 7: CD8-Targeted IL-15/Rα-Fc Fusions Demonstrate Enhanced Pharmacodynamics In a follow-on study in cynomolgus monkeys, one-arm scIL-15(N4D/N65D)/Rα-Fc with Xtend (XENP24294; sequences depicted in FIG. 40) and CD8-targeted IL-15 (N4D/N65D)/Rα-Fc with Xtend (XENP26585; sequences depicted in FIG. 102) were investigated. Cynomolgus (3 per group) were dosed with the test articles on Days 1 and 16, and blood was drawn over time to investigate T cell expansion. Data depicting CD8+ T cell and CD4+ T cell counts, as well as CD8+/CD4+ T cell ratio, are depicted in FIG. 107. Consistent with the study depicted in Example 6B, the CD8-targeted IL-15/Rα-Fc fusion selectively expanded CD8+ T cells over CD4+ T cells, enabling an enhanced CD8+/CD4+ T cell ratio. Notably, the CD8-targeted IL-15/Rα-Fc fusion had improved pharmacodynamics over the one-arm molecule as indicated by the longer duration of CD8+ T cell expansion.

Example 8: CD8-targeted IL-15 Fc Fusions Enhances Allogeneic Anti-Tumor Activity of CD8+ T Cells (In Vitro)

T cells were purified from human PBMCs (CMV+HLA-A0201) using EasySep™ Human T Cell Enrichment Kit (STEMCELL Technologies, Vancouver, Canada) according to the manufacturer's instructions. Purified T cells were incubated with CFSE-labeled parental MCF-7 tumor cells (designated in this Example as Group 1) or CFSE-labeled pp65-expressing MCF-7 tumor cells (designated in this Example as Group 1) at a 19:1 E:T ratio and the indicated test articles for 4 days. At Day 3, Brefeldin A (BioLegend, San Diego, Calif.) and anti-CD107a-PerCP/Cy5.5 (LAMP-1) were added to the cells. Following incubation, cells were incubated with Zombie Aqua™ Fixable Viability Kit (BioLegend, San Diego, Calif.) for 30 minutes at room temperature. Cells were washed and stained with anti-CD4-APC/eFluor780 (RPA-T4), anti-CD8b-PE/Cy7 (SIDI8BEE), anti-CD25-PE (M-A251), and anti-CD69-BV605 (FN50) for 1 hour on ice. Cells were washed again and stained with anti-IFNγ-BV421 (4S.B3) and anti-Ki67-APC using eBioscience™ Foxp3/Transcription Factor Staining Buffer Set (Thermo Fisher Scientific, Waltham, Mass.). Cells were analyzed by flow cytometry for various cell populations. Target cells were identified based on CFSE staining, and dead target cells were identified based on Zombie staining. Effector cells (CFSE-) were gated based on CD4 and CD8 expression.

Ki67 is a protein strictly associated with protein proliferation, while production of IFNγ by T cells indicates cytolytic activity. FIGS. 108A-108B respectively depict IFNγ+ fractions in CD8+ T cells in the two groups. FIGS. 109A-109B respectively depict Ki-67+ fractions of CD8+ T cells in the two groups. FIGS. 110A-110B respectively depict Ki-67+/IFNγ+ fractions of CD8+ T cells in the two groups. FIGS. 111A-111B respectively depict IFNγ+ fractions in CD4+ T cells in the two groups. FIGS. 112A-112B respectively depict Ki-67+ fractions of CD4+ T cells in the two groups. FIGS. 113A-113B respectively depict Ki-67+/IFNγ+ fractions of CD4+ T cells in the two groups. FIGS.

114A-114B respectively depict remaining target cells (either pp65-tranduced MCF-7 or parental MCF-7) in the two groups. Overall, the data show that the CD8-targeted IL-15/Rα-Fc fusions of the invention not only enhance allogeneic killing of tumor cells, but also that the CD8-targeted IL-15/Rα-Fc fusions selectively expand CD8+ T cells over CD4+ T cells.

Example 9: CD8-Targeted IL-15/Rα-Fc Fusions Enhance Allogeneic Anti-Tumor Effect of T Cells In Vivo and Combine Synergistically with Checkpoint Blockade Next, the in vivo anti-tumor effect of the CD8-targeted IL-15/Rα-Fc fusion proteins of the invention was investigated, as well as whether they were suitable for stacking with checkpoint blockade. Checkpoint blockade antibody used was XENP16432 (a bivalent anti-PD-1 mAb based on nivolumab with ablated effector function; sequence depicted in FIG. 12). NOD SCID gamma (NSG) mice (10 per group) were engrafted intradermally with 3×106 pp65-expressing MCF-7 cells in the rear flank on Day −14. On Day 0, mice were engrafted intraperitoneally with 5×106 human PBMCs from an HLA matched CMV+donor that screened positive for T cell pp65 reactivity (or PBS for control mice). Mice were treated weekly with the indicated test articles or PBS (for control mice) for 4 weeks (4 total doses). Tumor volumes were monitored by caliper measurements, data for which are shown (days post 1st dose) in FIGS. 115A-115B. Blood was drawn on Day 7, 12, 19, and 26 and analyzed by flow cytometry to count various lymphocyte populations as depicted in FIGS. 116A-116E.

The preceding merely illustrates the principles of the invention. It will be appreciated that those skilled in the art will be able to devise various arrangements which, although not explicitly described or shown herein, embody the principles of the invention and are included within its spirit and scope. Furthermore, all examples and conditional language recited herein are principally intended to aid the reader in understanding the principles of the invention being without limitation to such specifically recited examples and conditions. Moreover, all statements herein reciting principles, aspects, and embodiments of the invention as well as specific examples thereof, are intended to encompass both structural and functional equivalents thereof. Additionally, it is intended that such equivalents include both currently known equivalents and equivalents developed in the future, i.e., any elements developed that perform the same function, regardless of structure. The scope of the present invention, therefore, is not intended to be limited to the example embodiments shown and described herein. Rather, the scope and spirit of present invention is embodied by the appended claims. The examples set forth above are provided to give those of ordinary skill in the art a complete disclosure and description of how to make and use the embodiments of the compositions, systems and methods of the invention, and are not intended to limit the scope of what the inventors regard as their invention. Modifications of the above-described modes for carrying out the invention that are obvious to persons of skill in the art are intended to be within the scope of the following claims. All patents and publications mentioned in the specification are indicative of the levels of skill of those skilled in the art to which the invention pertains. All references cited in this disclosure are incorporated by reference to the same extent as if each reference had been incorporated by reference in its entirety individually.

All headings and section designations are used for clarity and reference purposes only and are not to be considered limiting in any way. For example, those of skill in the art will appreciate the usefulness of combining various aspects from different headings and sections as appropriate according to the spirit and scope of the invention described herein.

All references cited herein are hereby incorporated by reference herein in their entireties and for all purposes to the same extent as if each individual publication or patent or patent application was specifically and individually indicated to be incorporated by reference in its entirety for all purposes.

Many modifications and variations of this application can be made without departing from its spirit and scope, as will be apparent to those skilled in the art. The specific embodiments and examples described herein are offered by way of example only, and the application is to be limited only by the terms of the appended claims, along with the full scope of equivalents to which the claims are entitled.

SEQUENCE LISTING (994 sequences)

SEQ ID NO: 1 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 2 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 3 - protein, 267 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 4 - protein, 65 aa, Homo sapiens
ITCPPPMSVEHADIWVKSYSLYSRERYICNSGFKRKAGTSSLTECVLNKATNVAHWTTPSLKCIR

SEQ ID NO: 5 - protein, 6 aa, Artificial Sequence
  Description of Artificial Sequence: Synthetic 6xHis
HHHHHH

SEQ ID NO: 6 - protein, 9 aa, Homo sapiens
NLVPMVATV

SEQ ID NO: 7 - protein, 4 aa, Artificial Sequence
  Description of Artificial Sequence: Synthetic peptide
EPKS

SEQ ID NO: 8 - protein, 5 aa, Artificial Sequence
  Description of Artificial Sequence: Synthetic peptide
GSGGS

SEQ ID NO: 9 - protein, 5 aa, Artificial Sequence
  Description of Artificial Sequence: Synthetic peptide
GGGGS

SEQ ID NO: 10 - protein, 4 aa, Artificial Sequence
  Description of Artificial Sequence: Synthetic peptide
GGGS

SEQ ID NO: 11 - protein, 5 aa, Artificial Sequence
  Description of Artificial Sequence: Synthetic peptide
GGGGS

SEQ ID NO: 12 - protein, 10 aa, Artificial Sequence
  Description of Artificial Sequence: Synthetic peptide
GGGGSGGGGS

SEQ ID NO: 13 - protein, 15 aa, Artificial Sequence
  Description of Artificial Sequence: Synthetic peptide
GGGGSGGGGSGGGGS

SEQ ID NO: 14 - protein, 20 aa, Artificial Sequence
  Description of Artificial Sequence: Synthetic peptide
GGGGSGGGGSGGGGSGGGGS

SEQ ID NO: 15 - protein, 25 aa, Artificial Sequence
  Description of Artificial Sequence: Synthetic peptide
GGGGSGGGGSGGGGSGGGGSGGGGS

SEQ ID NO: 16 - protein, 30 aa, Artificial Sequence
  Description of Artificial Sequence: Synthetic polypeptide
GGGGSGGGGSGGGGSGGGGSGGGGSGGGGS

SEQ ID NO: 17 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 18 - protein, 30 aa, Artificial Sequence
  Description of Artificial Sequence: Synthetic polypeptide
DPALVHQRPAPPGGGGSGGGGSGGGGSGGG

SEQ ID NO: 19 - protein, 5 aa, Artificial Sequence
  Description of Artificial Sequence: Synthetic peptide
GKPGS

SEQ ID NO: 20 - protein, 25 aa, Artificial Sequence
  Description of Artificial Sequence: Synthetic peptide
GKPGSGKPGSGKPGSGKPGSGKPGS

SEQ ID NO: 21 - protein, 30 aa, Artificial Sequence
  Description of Artificial Sequence: Synthetic polypeptide
GKPGSGKPGSGKPGSGKPGSGKPGSGKPGS

SEQ ID NO: 22 - protein, 5 aa, Artificial Sequence
  Description of Artificial Sequence: Synthetic peptide
GGGES

SEQ ID NO: 23 - protein, 18 aa, Artificial Sequence
  Description of Artificial Sequence: Synthetic peptide
GSTSGSGKPGSGEGSTKG

SEQ ID NO: 24 - protein, 14 aa, Artificial Sequence
  Description of Artificial Sequence: Synthetic peptide
IRPRAIGGSKPRVA

SEQ ID NO: 25 - protein, 15 aa, Artificial Sequence
  Description of Artificial Sequence: Synthetic peptide
GKGGSGKGGSGKGGS

SEQ ID NO: 26 - protein, 15 aa, Artificial Sequence
  Description of Artificial Sequence: Synthetic peptide
GGKGSGGKGSGGKGS

SEQ ID NO: 27 - protein, 15 aa, Artificial Sequence
  Description of Artificial Sequence: Synthetic peptide
GGGKSGGGKSGGGKS

SEQ ID NO: 28 - protein, 15 aa, Artificial Sequence
  Description of Artificial Sequence: Synthetic peptide
GKGKSGKGKSGKGKS

SEQ ID NO: 29 - protein, 15 aa, Artificial Sequence
  Description of Artificial Sequence: Synthetic peptide
GGGKSGGKGSGKGGS

SEQ ID NO: 30 - protein, 15 aa, Artificial Sequence
  Description of Artificial Sequence: Synthetic peptide
GKPGSGKPGSGKPGS

SEQ ID NO: 31 - protein, 20 aa, Artificial Sequence
  Description of Artificial Sequence: Synthetic peptide
GKPGSGKPGSGKPGSGKPGS

SEQ ID NO: 32 - protein, 20 aa, Artificial Sequence
  Description of Artificial Sequence: Synthetic peptide
GKGKSGKGKSGKGKSGKGKS

SEQ ID NO: 33 - protein, 14 aa, Artificial Sequence
  Description of Artificial Sequence: Synthetic peptide
STAGDTHLGGEDFD

SEQ ID NO: 34 - protein, 15 aa, Artificial Sequence
  Description of Artificial Sequence: Synthetic peptide
GEGGSGEGGSGEGGS

SEQ ID NO: 35 - protein, 15 aa, Artificial Sequence
  Description of Artificial Sequence: Synthetic peptide
GGEGSGGEGSGGEGS

SEQ ID NO: 36 - protein, 15 aa, Artificial Sequence
  Description of Artificial Sequence: Synthetic peptide
GGGESGGGESGGGES

SEQ ID NO: 37 - protein, 15 aa, Artificial Sequence
  Description of Artificial Sequence: Synthetic peptide
GEGESGEGESGEGES

SEQ ID NO: 38 - protein, 15 aa, Artificial Sequence
  Description of Artificial Sequence: Synthetic peptide
GGGESGGEGSGEGGS

SEQ ID NO: 39 - protein, 20 aa, Artificial Sequence
  Description of Artificial Sequence: Synthetic peptide
GEGESGEGESGEGESGEGES

SEQ ID NO: 40 - protein, 19 aa, Artificial Sequence
  Description of Artificial Sequence: Synthetic peptide
PRGASKSGSASQTGSAPGS

SEQ ID NO: 41 - protein, 19 aa, Artificial Sequence
  Description of Artificial Sequence: Synthetic peptide
GTAAAGAGAAGGAAAGAAG

SEQ ID NO: 42 - protein, 19 aa, Artificial Sequence
  Description of Artificial Sequence: Synthetic peptide
GTSGSSGSGSGGSGSGGGG

SEQ ID NO: 43 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 45 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 231 aa, Artificial Sequence; identical to SEQ ID NO: 44
  Description of Artificial Sequence: Synthetic polypeptide
  IL-15/Ralpha-Fc monomer 2

SEQ ID NO: 47 - protein, 231 aa, Artificial Sequence; identical to SEQ ID NO: 45
  Description of Artificial Sequence: Synthetic polypeptide
  IL-15/Ralpha-Fc monomer 1

SEQ ID NO: 48 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 49 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 50 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 51 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 53 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 55 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 57 - protein, 229 aa, Artificial Sequence
  Description of Artificial Sequence: Synthetic polypeptide
  IL-15/Ralpha-Fc monomer 1
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 58 - protein, 229 aa, Artificial Sequence
  Description of Artificial Sequence: Synthetic polypeptide
  IL-15/Ralpha-Fc monomer 2
ESKYGPPCPPCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 59 - protein, 228 aa, Artificial Sequence
  Description of Artificial Sequence: Synthetic polypeptide
  IL-15/Ralpha-Fc monomer 1
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 60 - protein, 228 aa, Artificial Sequence
  Description of Artificial Sequence: Synthetic polypeptide
  IL-15/Ralpha-Fc monomer 2
ERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 61 - protein, 228 aa, Artificial Sequence
  Description of Artificial Sequence: Synthetic polypeptide
  IL-15/Ralpha-Fc monomer 1
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 62 - protein, 228 aa, Artificial Sequence
  Description of Artificial Sequence: Synthetic polypeptide
  IL-15/Ralpha-Fc monomer 2
ERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 63 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 64 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 65 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 231 aa, Artificial Sequence; identical to SEQ ID NO: 65
  Description of Artificial Sequence: Synthetic polypeptide
  IL-15/Ralpha-Fc monomer 2

SEQ ID NO: 67 - protein, 231 aa, Artificial Sequence; identical to SEQ ID NO: 44
  Description of Artificial Sequence: Synthetic polypeptide
  IL-15/Ralpha-Fc monomer 1

SEQ ID NO: 68 - protein, 231 aa, Artificial Sequence
  Description of Artificial Sequence: Synthetic polypeptide
  IL-15/Ralpha-Fc monomer 2
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 329 aa, Artificial Sequence
  Description of Artificial Sequence: Synthetic polypeptide
  IL-15/Ralpha x anti-CD8 Backbone 1 Chain 1
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 231 aa, Artificial Sequence; identical to SEQ ID NO: 44
  Description of Artificial Sequence: Synthetic polypeptide
  IL-15/Ralpha x anti-CD8 Backbone 1 Chain 2

SEQ ID NO: 71 - protein, 329 aa, Artificial Sequence
  Description of Artificial Sequence: Synthetic polypeptide
  IL-15/Ralpha x anti-CD8 Backbone 2 Chain 1
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 72 - protein, 231 aa, Artificial Sequence; identical to SEQ ID NO: 43
  Description of Artificial Sequence: Synthetic polypeptide
  IL-15/Ralpha x anti-CD8 Backbone 2 Chain 2

SEQ ID NO: 73 - protein, 329 aa, Artificial Sequence; identical to SEQ ID NO: 71
  Description of Artificial Sequence: Synthetic polypeptide
  IL-15/Ralpha x anti-CD8 Backbone 3 Chain 1

SEQ ID NO: 74 - protein, 329 aa, Artificial Sequence
  Description of Artificial Sequence: Synthetic polypeptide
  IL-15/Ralpha x anti-CD8 Backbone 3 Chain 2
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 107 aa, Artificial Sequence [sequence omitted]

SEQ ID NO: 76 - protein, 106 aa, Artificial Sequence
  Description of Artificial Sequence: Synthetic polypeptide
  Constant Light Chain - Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 77 - protein, 449 aa, Artificial Sequence
  Description of Artificial Sequence: Synthetic polypeptide
  XENP15074 Heavy Chain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 120 aa, Artificial Sequence [sequence omitted]

SEQ ID NO: 79 - protein, 7 aa, Artificial Sequence
  Description of Artificial Sequence: Synthetic peptide
  XENP15074 vhCDR1
TAGMSVG

SEQ ID NO: 80 - protein, 16 aa, Artificial Sequence
  Description of Artificial Sequence: Synthetic peptide
  XENP15074 vhCDR2
DIWWDDKKHYNPSLKD

SEQ ID NO: 81 - protein, 10 aa, Artificial Sequence
  Description of Artificial Sequence: Synthetic peptide
  XENP15074 vhCDR3
DMIFNFYFDV

SEQ ID NO: 82 - protein, 213 aa, Artificial Sequence
  Description of Artificial Sequence: Synthetic polypeptide
  XENP15074 Light Chain
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 83 - protein, 106 aa, Artificial Sequence [sequence omitted]

SEQ ID NO: 84 - protein, 10 aa, Artificial Sequence
  Description of Artificial Sequence: Synthetic peptide
  XENP15074 vlCDR1
SASSRVGYMH

SEQ ID NO: 85 - protein, 7 aa, Artificial Sequence
  Description of Artificial Sequence: Synthetic peptide
  XENP15074 vlCDR2
DTSKLAS

SEQ ID NO: 86 - protein, 9 aa, Artificial Sequence
  Description of Artificial Sequence: Synthetic peptide
  XENP15074 vlCDR3
FQGSGYPFT

SEQ ID NO: 87 - protein, 442 aa, Artificial Sequence
  Description of Artificial Sequence: Synthetic polypeptide
  XENP16432 Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 113 aa, Artificial Sequence [sequence omitted]

SEQ ID NO: 89 - protein, 5 aa, Artificial Sequence
  Description of Artificial Sequence: Synthetic peptide
  XENP16432 vhCDR1
NSGMH

SEQ ID NO: 90 - protein, 17 aa, Artificial Sequence
  Description of Artificial Sequence: Synthetic peptide
  XENP16432 vhCDR2
VIWYDGSKRYYADSVKG

SEQ ID NO: 91 - protein, 4 aa, Artificial Sequence
  Description of Artificial Sequence: Synthetic peptide
  XENP16432 vhCDR3
NDDY

SEQ ID NO: 92 - protein, 214 aa, Artificial Sequence
  Description of Artificial Sequence: Synthetic polypeptide
  XENP16432 Light Chain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 93 - protein, 107 aa, Artificial Sequence [sequence omitted]

SEQ ID NO: 94 - protein, 11 aa, Artificial Sequence
  Description of Artificial Sequence: Synthetic peptide
  XENP16432 vlCDR1
RASQSVSSYLA

SEQ ID NO: 95 - protein, 7 aa, Artificial Sequence
  Description of Artificial Sequence: Synthetic peptide
  XENP16432 vlCDR2
DASNRAT

SEQ ID NO: 96 - protein, 9 aa, Artificial Sequence
  Description of Artificial Sequence: Synthetic peptide
  XENP16432 vlCDR3
QQSSNWPRT

SEQ ID NO: 97 - protein, 435 aa, Artificial Sequence
  Description of Artificial Sequence: Synthetic polypeptide
  XENP26007 Chain 1
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 98 - protein, 65 aa, Artificial Sequence; identical to SEQ ID NO: 4
  Description of Artificial Sequence: Synthetic polypeptide
  XENP26007 Human IL15Ralpha (sushi)

SEQ ID NO: 99 - protein, 114 aa, Artificial Sequence
  Description of Artificial Sequence: Synthetic polypeptide
  XENP26007 Human IL15
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 100 - protein, 231 aa, Artificial Sequence; identical to SEQ ID NO: 44
  Description of Artificial Sequence: Synthetic polypeptide
  Fc Chain of XENP26007

SEQ ID NO: 101 - protein, 449 aa, Artificial Sequence
  Description of Artificial Sequence: Synthetic polypeptide
  XENP26007 Chain 2
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 120 aa, Artificial Sequence [sequence omitted]

SEQ ID NO: 103 - protein, 7 aa, Artificial Sequence
  Description of Artificial Sequence: Synthetic peptide
  XENP26007 vhCDR1
TAGMSVG

SEQ ID NO: 104 - protein, 16 aa, Artificial Sequence
  Description of Artificial Sequence: Synthetic peptide
  XENP26007 vhCDR2
DIWWDDKKHYNPSLKD

SEQ ID NO: 105 - protein, 10 aa, Artificial Sequence
  Description of Artificial Sequence: Synthetic peptide
  XENP26007 vhCDR3
DMIFNFYFDV

SEQ ID NO: 106 - protein, 213 aa, Artificial Sequence; identical to SEQ ID NO: 82
  Description of Artificial Sequence: Synthetic polypeptide
  XENP26007 Chain 3

SEQ ID NO: 107 - protein, 106 aa, Artificial Sequence [sequence omitted]

SEQ ID NO: 108 - protein, 10 aa, Artificial Sequence
  Description of Artificial Sequence: Synthetic peptide
  XENP26007 vlCDR1
SASSRVGYMH

SEQ ID NO: 109 - protein, 7 aa, Artificial Sequence
  Description of Artificial Sequence: Synthetic peptide
  XENP26007 vlCDR2
DTSKLAS

SEQ ID NO: 110 - protein, 9 aa, Artificial Sequence
  Description of Artificial Sequence: Synthetic peptide
  XENP26007 vlCDR3
FQGSGYPFT

SEQ ID NO: 111 - protein, 162 aa, Homo sapiens; identical to SEQ ID NO: 1

SEQ ID NO: 112 - protein, 114 aa, Homo sapiens; identical to SEQ ID NO: 2

SEQ ID NO: 113 - protein, 267 aa, Homo sapiens; identical to SEQ ID NO: 3

SEQ ID NO: 114 - protein, 175 aa, Homo sapiens
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 115 - protein, 65 aa, Homo sapiens; identical to SEQ ID NO: 4

SEQ ID NO: 116 - protein, 551 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 117 - protein, 214 aa, Homo sapiens
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 118 - protein, 369 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 119 - protein, 240 aa, Homo sapiens
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEA

SEQ ID NO: 120 - protein, 350 aa, Artificial Sequence
  Description of Artificial Sequence: Synthetic polypeptide
  XENP20818 Chain 1
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 121 - protein, 114 aa, Artificial Sequence; identical to SEQ ID NO: 2
  Description of Artificial Sequence: Synthetic polypeptide
  XENP20818 Human IL15

SEQ ID NO: 122 - protein, 231 aa, Artificial Sequence; identical to SEQ ID NO: 44
  Description of Artificial Sequence: Synthetic polypeptide
  Fc Chain of XENP20818

SEQ ID NO: 123 - protein, 301 aa, Artificial Sequence
  Description of Artificial Sequence: Synthetic polypeptide
  XENP20818 Chain 2
ITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 65 aa, Artificial Sequence; identical to SEQ ID NO: 4
  Description of Artificial Sequence: Synthetic polypeptide
  XENP20818 Human IL15Ralpha (sushi)

SEQ ID NO: 125 - protein, 231 aa, Artificial Sequence; identical to SEQ ID NO: 43
  Description of Artificial Sequence: Synthetic polypeptide
  Fc Chain of XENP20818

SEQ ID NO: 126 - protein, 345 aa, Artificial Sequence
  Description of Artificial Sequence: Synthetic polypeptide
  XENP21475 Chain 1
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 127 - protein, 114 aa, Artificial Sequence; identical to SEQ ID NO: 2
  Description of Artificial Sequence: Synthetic polypeptide
  XENP21475 Human IL15

SEQ ID NO: 128 - protein, 231 aa, Artificial Sequence; identical to SEQ ID NO: 44
  Description of Artificial Sequence: Synthetic polypeptide
  Fc Chain of XENP21475

SEQ ID NO: 129 - protein, 296 aa, Artificial Sequence
  Description of Artificial Sequence: Synthetic polypeptide
  XENP21475 Chain 2
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 130 - protein, 65 aa, Artificial Sequence; identical to SEQ ID NO: 4
  Description of Artificial Sequence: Synthetic polypeptide
  XENP21475 Human IL15Ralpha (sushi)

SEQ ID NO: 131 - protein, 231 aa, Artificial Sequence; identical to SEQ ID NO: 43
  Description of Artificial Sequence: Synthetic polypeptide
  Fc Chain of XENP21475

SEQ ID NO: 132 - protein, 440 aa, Artificial Sequence
  Description of Artificial Sequence: Synthetic polypeptide
  XENP21478 Chain 1
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 133 - protein, 65 aa, Artificial Sequence; identical to SEQ ID NO: 4
  Description of Artificial Sequence: Synthetic polypeptide
  XENP21478 Human IL15Ralpha (sushi)

SEQ ID NO: 134 - protein, 114 aa, Artificial Sequence; identical to SEQ ID NO: 2
  Description of Artificial Sequence: Synthetic polypeptide
  XENP21478 Human IL15

SEQ ID NO: 135 - protein, 231 aa, Artificial Sequence; identical to SEQ ID NO: 44
  Description of Artificial Sequence: Synthetic polypeptide
  Fc Chain of XENP21478

SEQ ID NO: 136 - protein, 231 aa, Artificial Sequence; identical to SEQ ID NO: 43
  Description of Artificial Sequence: Synthetic polypeptide
  XENP21478 Chain 2

SEQ ID NO: 137 - protein, 435 aa, Artificial Sequence
  Description of Artificial Sequence: Synthetic polypeptide
  XENP21993 Chain 1
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 138 - protein, 65 aa, Artificial Sequence; identical to SEQ ID NO: 4
  Description of Artificial Sequence: Synthetic polypeptide
  XENP21993 Human IL15Ralpha (sushi)

SEQ ID NO: 139 - protein, 114 aa, Artificial Sequence; identical to SEQ ID NO: 2
  Description of Artificial Sequence: Synthetic polypeptide
  XENP21993 Human IL15

SEQ ID NO: 140 - protein, 231 aa, Artificial Sequence; identical to SEQ ID NO: 44
  Description of Artificial Sequence: Synthetic polypeptide
  Fc Chain of XENP21993

SEQ ID NO: 141 - protein, 231 aa, Artificial Sequence; identical to SEQ ID NO: 43
  Description of Artificial Sequence: Synthetic polypeptide
  XENP21993 Chain 2

SEQ ID NO: 142 - protein, 435 aa, Artificial Sequence
  Description of Artificial Sequence: Synthetic polypeptide
  XENP24013 Chain 1
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 143 - protein, 65 aa, Artificial Sequence; identical to SEQ ID NO: 4
  Description of Artificial Sequence: Synthetic polypeptide
  XENP24013 Human IL15Ralpha (sushi)

SEQ ID NO: 144 - protein, 114 aa, Artificial Sequence
  Description of Artificial Sequence: Synthetic polypeptide
  XENP24013 Human IL15
NWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 145 - protein, 231 aa, Artificial Sequence; identical to SEQ ID NO: 44
  Description of Artificial Sequence: Synthetic polypeptide
  Fc Chain of XENP24013

SEQ ID NO: 146 - protein, 231 aa, Artificial Sequence; identical to SEQ ID NO: 43
  Description of Artificial Sequence: Synthetic polypeptide
  XENP24013 Chain 2

SEQ ID NO: 147 - protein, 114 aa, Artificial Sequence; identical to SEQ ID NO: 2
  Description of Artificial Sequence: Synthetic polypeptide
  XENP21479 Chain 1

SEQ ID NO: 148 - protein, 231 aa, Artificial Sequence; identical to SEQ ID NO: 44
  Description of Artificial Sequence: Synthetic polypeptide
  XENP21479 Chain 2

SEQ ID NO: 149 - protein, 296 aa, Artificial Sequence; identical to SEQ ID NO: 129
  Description of Artificial Sequence: Synthetic polypeptide
  XENP21479 Chain 3

SEQ ID NO: 150 - protein, 65 aa, Artificial Sequence; identical to SEQ ID NO: 4
  Description of Artificial Sequence: Synthetic polypeptide
  XENP21479 Human IL15Ralpha (sushi)

SEQ ID NO: 151 - protein, 231 aa, Artificial Sequence; identical to SEQ ID NO: 43
  Description of Artificial Sequence: Synthetic polypeptide
  Fc Chain of XENP21479

SEQ ID NO: 152 - protein, 114 aa, Artificial Sequence; identical to SEQ ID NO: 2
  Description of Artificial Sequence: Synthetic polypeptide
  XENP022366 Chain 1

SEQ ID NO: 153 - protein, 231 aa, Artificial Sequence; identical to SEQ ID NO: 44
  Description of Artificial Sequence: Synthetic polypeptide
  XENP022366 Chain 2

SEQ ID NO: 154 - protein, 301 aa, Artificial Sequence; identical to SEQ ID NO: 123
  Description of Artificial Sequence: Synthetic polypeptide
  XENP022366 Chain 3

SEQ ID NO: 155 - protein, 65 aa, Artificial Sequence; identical to SEQ ID NO: 4
  Description of Artificial Sequence: Synthetic polypeptide
  XENP022366 Human IL15Ralpha (sushi)

SEQ ID NO: 156 - protein, 231 aa, Artificial Sequence; identical to SEQ ID NO: 43
  Description of Artificial Sequence: Synthetic polypeptide
  Fc Chain of XENP022366

SEQ ID NO: 157 - protein, 114 aa, Artificial Sequence; identical to SEQ ID NO: 2
  Description of Artificial Sequence: Synthetic polypeptide
  XENP024348 Chain 1

SEQ ID NO: 158 - protein, 296 aa, Artificial Sequence
  Description of Artificial Sequence: Synthetic polypeptide
  XENP024348 Chain 2
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 159 - protein, 65 aa, Artificial Sequence; identical to SEQ ID NO: 4
  Description of Artificial Sequence: Synthetic polypeptide
  XENP024348 Human IL15Ralpha (sushi)

SEQ ID NO: 160 - protein, 231 aa, Artificial Sequence; identical to SEQ ID NO: 44
  Description of Artificial Sequence: Synthetic polypeptide
  Fc Chain of XENP024348

SEQ ID NO: 161 - protein, 231 aa, Artificial Sequence; identical to SEQ ID NO: 43
  Description of Artificial Sequence: Synthetic polypeptide
  XENP024348 Chain 3

SEQ ID NO: 162 - protein, 296 aa, Artificial Sequence
  Description of Artificial Sequence: Synthetic polypeptide
  XENP021978 Chain 1
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 65 aa, Artificial Sequence; identical to SEQ ID NO: 4
  Description of Artificial Sequence: Synthetic polypeptide
  XENP021978 Human IL15Ralpha (sushi)

SEQ ID NO: 164 - protein, 231 aa, Artificial Sequence; identical to SEQ ID NO: 65
  Description of Artificial Sequence: Synthetic polypeptide
  Fc Chain of XENP021978

SEQ ID NO: 165 - protein, 114 aa, Artificial Sequence; identical to SEQ ID NO: 2
  Description of Artificial Sequence: Synthetic polypeptide
  XENP021978 Chain 2

SEQ ID NO: 166 - protein, 415 aa, Artificial Sequence
  Description of Artificial Sequence: Synthetic polypeptide
  human_IL15(single-chain)-human_IL15Ra(Sushi)_Fc(216) _IgG1_C220S/PVA_/S267K
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 114 aa, Artificial Sequence; identical to SEQ ID NO: 2
  Description of Artificial Sequence: Synthetic polypeptide
  human_IL15(single-chain)-human_IL15Ra(Sushi)_Fc(216) _IgG1_C220S/PVA_/S267K Human IL15

SEQ ID NO: 168 - protein, 65 aa, Artificial Sequence; identical to SEQ ID NO: 4
  Description of Artificial Sequence: Synthetic polypeptide
  human_IL15(single-chain)-human_IL15Ra(Sushi)_Fc(216) _IgG1_C220S/PVA_/S267K Human IL15Ralpha (sushi)

SEQ ID NO: 169 - protein, 231 aa, Artificial Sequence; identical to SEQ ID NO: 65
  Description of Artificial Sequence: Synthetic polypeptide
  Fc Chain of human_IL15(single-chain)-human_IL15Ra(Sushi) _Fc(216)_IgG1_C220S/PVA_/S267K

SEQ ID NO: 170 - protein, 306 aa, Artificial Sequence
  Description of Artificial Sequence: Synthetic polypeptide
  XENP022637 Chain 1
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 171 - protein, 231 aa, Artificial Sequence; identical to SEQ ID NO: 44
  Description of Artificial Sequence: Synthetic polypeptide
  Fc Chain of XENP022637

SEQ ID NO: 172 - protein, 65 aa, Artificial Sequence; identical to SEQ ID NO: 4
  Description of Artificial Sequence: Synthetic polypeptide
  XENP022637 IL15Ralpha(sushi)

SEQ ID NO: 173 - protein, 231 aa, Artificial Sequence; identical to SEQ ID NO: 68
  Description of Artificial Sequence: Synthetic polypeptide
  XENP022637 Chain 2

SEQ ID NO: 174 - protein, 114 aa, Artificial Sequence; identical to SEQ ID NO: 2
  Description of Artificial Sequence: Synthetic polypeptide
  XENP022637 Chain 3

SEQ ID NO: 175 - protein, 231 aa, Artificial Sequence; identical to SEQ ID NO: 44
  Description of Artificial Sequence: Synthetic polypeptide
  XENP022638 Chain 1

SEQ ID NO: 176 - protein, 306 aa, Artificial Sequence
  Description of Artificial Sequence: Synthetic polypeptide
  XENP022638 Chain 2
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 177 - protein, 231 aa, Artificial Sequence; identical to SEQ ID NO: 68
  Description of Artificial Sequence: Synthetic polypeptide
  Fc Chain of XENP022638

SEQ ID NO: 178 - protein, 65 aa, Artificial Sequence; identical to SEQ ID NO: 4
  Description of Artificial Sequence: Synthetic polypeptide
  XENP022638 IL15Ralpha(sushi)

SEQ ID NO: 179 - protein, 114 aa, Artificial Sequence; identical to SEQ ID NO: 2
  Description of Artificial Sequence: Synthetic polypeptide
  XENP022638 Chain 3

SEQ ID NO: 180 - protein, 425 aa, Artificial Sequence
  Description of Artificial Sequence: Synthetic polypeptide
  Chain 1 - empty-Fc(216)_IgG1_pI(-)_Isosteric_A_C220S /PVA_/S267K/L368D/K370S_(GGGGS)2_IL15Ra(Sushi)_IL15 (single-chain)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 181 - protein, 231 aa, Artificial Sequence; identical to SEQ ID NO: 44
  Description of Artificial Sequence: Synthetic polypeptide
  Fc chain of Chain 1 - empty-Fc(216)_IgG1_pI(-)_Isosteric _A_C220S/PVA_/S267K/L368D/K370S_(GGGGS)2_IL15Ra(Sushi) _IL15(single-chain)

SEQ ID NO: 182 - protein, 65 aa, Artificial Sequence; identical to SEQ ID NO: 4
  Description of Artificial Sequence: Synthetic polypeptide
  Chain 1 - empty-Fc(216)_IgG1_pI(-)_Isosteric_A_C220S /PVA_/S267K/L368D/K370S_(GGGGS)2_IL15Ra(Sushi)_IL15 (single-chain) IL15Ralpha(sushi)

SEQ ID NO: 183 - protein, 114 aa, Artificial Sequence; identical to SEQ ID NO: 2
  Description of Artificial Sequence: Synthetic polypeptide
  Chain 1 - empty-Fc(216)_IgG1_pI(-)_Isosteric_A_C220S /PVA_/S267K/L368D/K370S_(GGGGS)2_IL15Ra(Sushi)_IL15 (single-chain) IL15

SEQ ID NO: 184 - protein, 231 aa, Artificial Sequence; identical to SEQ ID NO: 68
  Description of Artificial Sequence: Synthetic polypeptide
  Chain 2 - empty-Fc(216)_IgG1_ISO(+RR)_C220S/PVA_/ S267K/S364K/E357Q (8927)

SEQ ID NO: 185 - protein, 66 aa, Artificial Sequence
  Description of Artificial Sequence: Synthetic polypeptide
  IL-15Ralpha(sushi-D96)
ITCPPPMSVEHADIWVKSYSLYSRERYICNSGFKRKAGTSSLTECVLNKATNVAHWTTPSLKCIRD

SEQ ID NO: 186 - protein, 67 aa, Artificial Sequence
  Description of Artificial Sequence: Synthetic polypeptide
  IL-15Ralpha(sushi-D96/P97)
ITCPPPMSVEHADIWVKSYSLYSRERYICNSGFKRKAGTSSLTECVLNKATNVAHWTTPSLKCIRDP

SEQ ID NO: 187 - protein, 68 aa, Artificial Sequence
  Description of Artificial Sequence: Synthetic polypeptide
  IL-15Ralpha(sushi-D96/P97/A98)
ITCPPPMSVEHADIWVKSYSLYSRERYICNSGFKRKAGTSSLTECVLNKATNVAHWTTPSLKCIRDPA

SEQ ID NO: 188 - protein, 114 aa, Artificial Sequence
  Description of Artificial Sequence: Synthetic polypeptide
  IL-15(E87C)
NWVNVISDLKKIEDLIQSMHIDATLYTESDVHPSCKVTAMKCFLLELQVISLESGDASIHDTVENLIILANNSLSSNGNVTESGCKCCEELEEKNIKEFLQSFVHIVQMFINTS

SEQ ID NO: 189 - protein, 114 aa, Artificial Sequence
  Description of Artificial Sequence: Synthetic polypeptide
  IL-15(V49C)
NWVNVISDLKKIEDLIQSMHIDATLYTESDVHPSCKVTAMKCFLLELQCISLESGDASIHDTVENLIILANNSLSSNGNVTESGCKECEELEEKNIKEFLQSFVHIVQMFINTS

SEQ ID NO: 190 - protein, 114 aa, Artificial Sequence
  Description of Artificial Sequence: Synthetic polypeptide
  IL-15(L52C)
NWVNVISDLKKIEDLIQSMHIDATLYTESDVHPSCKVTAMKCFLLELQVISCESGDASIHDTVENLIILANNSLSSNGNVTESGCKECEELEEKNIKEFLQSFVHIVQMFINTS

SEQ ID NO: 191 - protein, 114 aa, Artificial Sequence
  Description of Artificial Sequence: Synthetic polypeptide
  IL-15(E89C)
NWVNVISDLKKIEDLIQSMHIDATLYTESDVHPSCKVTAMKCFLLELQVISLESGDASIHDTVENLIILANNSLSSNGNVTESGCKECCELEEKNIKEFLQSFVHIVQMFINTS

SEQ ID NO: 192 - protein, 114 aa, Artificial Sequence
  Description of Artificial Sequence: Synthetic polypeptide
  IL-15(Q48C)
NWVNVISDLKKIEDLIQSMHIDATLYTESDVHPSCKVTAMKCFLLELCVISLESGDASIHDTVENLIILANNSLSSNGNVTESGCKECEELEEKNIKEFLQSFVHIVQMFINTS

SEQ ID NO: 193 - protein, 114 aa, Artificial Sequence
  Description of Artificial Sequence: Synthetic polypeptide
  IL-15(E53C)
NWVNVISDLKKIEDLIQSMHIDATLYTESDVHPSCKVTAMKCFLLELQVISLCSGDASIHDTVENLIILANNSLSSNGNVTESGCKECEELEEKNIKEFLQSFVHIVQMFINTS

SEQ ID NO: 194 - protein, 114 aa, Artificial Sequence
  Description of Artificial Sequence: Synthetic polypeptide
  IL-15(C42S)
NWVNVISDLKKIEDLIQSMHIDATLYTESDVHPSCKVTAMKSFLLELQVISLESGDASIHDTVENLIILANNSLSSNGNVTESGCKECEELEEKNIKEFLQSFVHIVQMFINTS

SEQ ID NO: 195 - protein, 114 aa, Artificial Sequence
  Description of Artificial Sequence: Synthetic polypeptide
  IL-15(L45C)
NWVNVISDLKKIEDLIQSMHIDATLYTESDVHPSCKVTAMKCFLCELQVISLESGDASIHDTVENLIILANNSLSSNGNVTESGCKECEELEEKNIKEFLQSFVHIVQMFINTS

SEQ ID NO: 196 - protein, 67 aa, Artificial Sequence
  Description of Artificial Sequence: Synthetic polypeptide
  IL-15Ralpha(sushi-D96/C97)
ITCPPPMSVEHADIWVKSYSLYSRERYICNSGFKRKAGTSSLTECVLNKATNVAHWTTPSLKCIRDC

SEQ ID NO: 197 - protein, 68 aa, Artificial Sequence
  Description of Artificial Sequence: Synthetic polypeptide
  IL-15Ralpha(sushi-D96/P97/C98)
ITCPPPMSVEHADIWVKSYSLYSRERYICNSGFKRKAGTSSLTECVLNKATNVAHWTTPSLKCIRDPC

SEQ ID NO: 198 - protein, 68 aa, Artificial Sequence
  Description of Artificial Sequence: Synthetic polypeptide
  IL-15Ralpha(sushi-D96/C97/A98)
ITCPPPMSVEHADIWVKSYSLYSRERYICNSGFKRKAGTSSLTECVLNKATNVAHWTTPSLKCIRDCA

SEQ ID NO: 199 - protein, 65 aa, Artificial Sequence
  Description of Artificial Sequence: Synthetic polypeptide
  IL-15Ralpha(sushi-S40C)
ITCPPPMSVEHADIWVKSYSLYSRERYICNSGFKRKAGTCSLTECVLNKATNVAHWTTPSLKCIR

SEQ ID NO: 200 - protein, 65 aa, Artificial Sequence
  Description of Artificial Sequence: Synthetic polypeptide
  IL-15Ralpha(sushi-K34C)
ITCPPPMSVEHADIWVKSYSLYSRERYICNSGFCRKAGTSSLTECVLNKATNVAHWTTPSLKCIR

SEQ ID NO: 201 - protein, 65 aa, Artificial Sequence
  Description of Artificial Sequence: Synthetic polypeptide
  IL-15Ralpha(sushi-G38C)
ITCPPPMSVEHADIWVKSYSLYSRERYICNSGFKRKACTSSLTECVLNKATNVAHWTTPSLKCIR

SEQ ID NO: 202 - protein, 65 aa, Artificial Sequence
  Description of Artificial Sequence: Synthetic polypeptide
  IL-15Ralpha(sushi-L42C)
ITCPPPMSVEHADIWVKSYSLYSRERYICNSGFKRKAGTSSCTECVLNKATNVAHWTTPSLKCIR

SEQ ID NO: 203 - protein, 65 aa, Artificial Sequence
  Description of Artificial Sequence: Synthetic polypeptide
  IL-15Ralpha(sushi-A37C)
ITCPPPMSVEHADIWVKSYSLYSRERYICNSGFKRKCGTSSLTECVLNKATNVAHWTTPSLKCIR

SEQ ID NO: 204 - protein, 350 aa, Artificial Sequence
  Description of Artificial Sequence: Synthetic polypeptide
  XENP022013 Chain 1
NWVNVISDLKKIEDLIQSMHIDATLYTESDVHPSCKVTAMKCFLLELQVISLESGDASIHDTVENLIILANNSLSSNGNVTESGCKCCEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 205 - protein, 114 aa, Artificial Sequence; identical to SEQ ID NO: 188
  Description of Artificial Sequence: Synthetic polypeptide
  XENP022013 Human IL15

SEQ ID NO: 206 - protein, 231 aa, Artificial Sequence; identical to SEQ ID NO: 44
  Description of Artificial Sequence: Synthetic polypeptide
  Fc Chain of XENP022013

SEQ ID NO: 207 - protein, 303 aa, Artificial Sequence
  Description of Artificial Sequence: Synthetic polypeptide
  XENP022013 Chain 2
ITCPPPMSVEHADIWVKSYSLYSRERYICNSGFKRKAGTSSLTECVLNKATNVAHWTTPSLKCIRDCGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 208 - protein, 67 aa, Artificial Sequence; identical to SEQ ID NO: 196
  Description of Artificial Sequence: Synthetic polypeptide
  XENP022013 Human IL15Ralpha (sushi)

SEQ ID NO: 209 - protein, 231 aa, Artificial Sequence; identical to SEQ ID NO: 43
  Description of Artificial Sequence: Synthetic polypeptide
  Fc Chain of XENP022013

SEQ ID NO: 210 - protein, 350 aa, Artificial Sequence; identical to SEQ ID NO: 204
  Description of Artificial Sequence: Synthetic polypeptide
  XENP022014 Chain 1

SEQ ID NO: 211 - protein, 114 aa, Artificial Sequence; identical to SEQ ID NO: 188
  Description of Artificial Sequence: Synthetic polypeptide
  XENP022014 Human IL15

SEQ ID NO: 212 - protein, 231 aa, Artificial Sequence; identical to SEQ ID NO: 44
  Description of Artificial Sequence: Synthetic polypeptide
  Fc Chain of XENP022014

SEQ ID NO: 213 - protein, 304 aa, Artificial Sequence
  Description of Artificial Sequence: Synthetic polypeptide
  XENP022014 Chain 2
ITCPPPMSVEHADIWVKSYSLYSRERYICNSGFKRKAGTSSLTECVLNKATNVAHWTTPSLKCIRDPCGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 214 - protein, 68 aa, Artificial Sequence; identical to SEQ ID NO: 197
  Description of Artificial Sequence: Synthetic polypeptide
  XENP022014 Human IL15Ralpha (sushi)

SEQ ID NO: 215 - protein, 231 aa, Artificial Sequence; identical to SEQ ID NO: 43
  Description of Artificial Sequence: Synthetic polypeptide
  Fc Chain of XENP022014

SEQ ID NO: 216 - protein, 350 aa, Artificial Sequence; identical to SEQ ID NO: 204
  Description of Artificial Sequence: Synthetic polypeptide
  XENP022015 Chain 1

SEQ ID NO: 217 - protein, 114 aa, Artificial Sequence; identical to SEQ ID NO: 188
  Description of Artificial Sequence: Synthetic polypeptide
  XENP022015 Human IL15

SEQ ID NO: 218 - protein, 231 aa, Artificial Sequence; identical to SEQ ID NO: 44
  Description of Artificial Sequence: Synthetic polypeptide
  Fc Chain of XENP022015

SEQ ID NO: 219 - protein, 304 aa, Artificial Sequence
  Description of Artificial Sequence: Synthetic polypeptide
  XENP022015 Chain 2
ITCPPPMSVEHADIWVKSYSLYSRERYICNSGFKRKAGTSSLTECVLNKATNVAHWTTPSLKCIRDCAGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 68 aa, Artificial Sequence; identical to SEQ ID NO: 198
  Description of Artificial Sequence: Synthetic polypeptide
  XENP022015 Human IL15Ralpha (sushi)

SEQ ID NO: 221 - protein, 231 aa, Artificial Sequence; identical to SEQ ID NO: 43
  Description of Artificial Sequence: Synthetic polypeptide
  Fc Chain of XENP022015

SEQ ID NO: 222 - protein, 350 aa, Artificial Sequence
  Description of Artificial Sequence: Synthetic polypeptide
  XENP022017 Chain 1
NWVNVISDLKKIEDLIQSMHIDATLYTESDVHPSCKVTAMKCFLLELQVISCESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 223 - protein, 114 aa, Artificial Sequence; identical to SEQ ID NO: 190
  Description of Artificial Sequence: Synthetic polypeptide
  XENP022017 Human IL15

SEQ ID NO: 224 - protein, 231 aa, Artificial Sequence; identical to SEQ ID NO: 44
  Description of Artificial Sequence: Synthetic polypeptide
  Fc Chain of XENP022017

SEQ ID NO: 225 - protein, 301 aa, Artificial Sequence
  Description of Artificial Sequence: Synthetic polypeptide
  XENP022017 Chain 2
ITCPPPMSVEHADIWVKSYSLYSRERYICNSGFKRKAGTCSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 226 - protein, 65 aa, Artificial Sequence; identical to SEQ ID NO: 199
  Description of Artificial Sequence: Synthetic polypeptide
  XENP022017 Human IL15Ralpha (sushi)

SEQ ID NO: 227 - protein, 231 aa, Artificial Sequence; identical to SEQ ID NO: 43
  Description of Artificial Sequence: Synthetic polypeptide
  Fc Chain of XENP022017

SEQ ID NO: 228 - protein, 114 aa, Artificial Sequence; identical to SEQ ID NO: 188
  Description of Artificial Sequence: Synthetic polypeptide
  XENP022358 Chain 1

SEQ ID NO: 229 - protein, 231 aa, Artificial Sequence; identical to SEQ ID NO: 44
  Description of Artificial Sequence: Synthetic polypeptide
  XENP022358 Chain 2

SEQ ID NO: 230 - protein, 304 aa, Artificial Sequence; identical to SEQ ID NO: 213
  Description of Artificial Sequence: Synthetic polypeptide
  XENP022358 Chain 3

SEQ ID NO: 231 - protein, 68 aa, Artificial Sequence; identical to SEQ ID NO: 197
  Description of Artificial Sequence: Synthetic polypeptide
  XENP022358 Human IL15Ralpha (sushi)

SEQ ID NO: 232 - protein, 231 aa, Artificial Sequence; identical to SEQ ID NO: 43
  Description of Artificial Sequence: Synthetic polypeptide
  Fc Chain of XENP022358

SEQ ID NO: 233 - protein, 114 aa, Artificial Sequence; identical to SEQ ID NO: 188
  Description of Artificial Sequence: Synthetic polypeptide
  XENP022359 Chain 1

SEQ ID NO: 234 - protein, 231 aa, Artificial Sequence; identical to SEQ ID NO: 44
  Description of Artificial Sequence: Synthetic polypeptide
  XENP022359 Chain 2

SEQ ID NO: 235 - protein, 304 aa, Artificial Sequence; identical to SEQ ID NO: 219
  Description of Artificial Sequence: Synthetic polypeptide
  XENP022359 Chain 3

SEQ ID NO: 236 - protein, 68 aa, Artificial Sequence; identical to SEQ ID NO: 198
  Description of Artificial Sequence: Synthetic polypeptide
  XENP022359 Human IL15Ralpha (sushi)

SEQ ID NO: 237 - protein, 231 aa, Artificial Sequence; identical to SEQ ID NO: 43
  Description of Artificial Sequence: Synthetic polypeptide
  Fc Chain of XENP022359

SEQ ID NO: 238 - protein, 114 aa, Artificial Sequence; identical to SEQ ID NO: 190
  Description of Artificial Sequence: Synthetic polypeptide
  XENP022361 Chain 1

SEQ ID NO: 239 - protein, 231 aa, Artificial Sequence; identical to SEQ ID NO: 44
  Description of Artificial Sequence: Synthetic polypeptide
  XENP022361 Chain 2

SEQ ID NO: 240 - protein, 301 aa, Artificial Sequence; identical to SEQ ID NO: 225
  Description of Artificial Sequence: Synthetic polypeptide
  XENP022361 Chain 3

SEQ ID NO: 241 - protein, 65 aa, Artificial Sequence; identical to SEQ ID NO: 199
  Description of Artificial Sequence: Synthetic polypeptide
  XENP022361 Human IL15Ralpha (sushi)

SEQ ID NO: 242 - protein, 231 aa, Artificial Sequence; identical to SEQ ID NO: 43
  Description of Artificial Sequence: Synthetic polypeptide
  Fc Chain of XENP022361

SEQ ID NO: 243 - protein, 114 aa, Artificial Sequence; identical to SEQ ID NO: 188
  Description of Artificial Sequence: Synthetic polypeptide
  XENP022684 Chain 1

SEQ ID NO: 244 - protein, 299 aa, Artificial Sequence
  Description of Artificial Sequence: Synthetic polypeptide
  XENP022684 Chain 2
ITCPPPMSVEHADIWVKSYSLYSRERYICNSGFKRKAGTSSLTECVLNKATNVAHWTTPSLKCIRDCAEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 245 - protein, 68 aa, Artificial Sequence; identical to SEQ ID NO: 198
  Description of Artificial Sequence: Synthetic polypeptide
  XENP022684 IL15Ralpha(sushi)

SEQ ID NO: 246 - protein, 231 aa, Artificial Sequence; identical to SEQ ID NO: 43
  Description of Artificial Sequence: Synthetic polypeptide
  Fc Chain of XENP022684

SEQ ID NO: 247 - protein, 298 aa, Artificial Sequence
  Description of Artificial Sequence: Synthetic polypeptide
  XENP022634 Chain 1
ITCPPPMSVEHADIWVKSYSLYSRERYICNSGFKRKAGTSSLTECVLNKATNVAHWTTPSLKCIRDCEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 248 - protein, 67 aa, Artificial Sequence; identical to SEQ ID NO: 196
  Description of Artificial Sequence: Synthetic polypeptide
  XENP022634 Human IL15Ralpha (sushi)

SEQ ID NO: 249 - protein, 231 aa, Artificial Sequence; identical to SEQ ID NO: 65
  Description of Artificial Sequence: Synthetic polypeptide
  Fc Chain of XENP022634

SEQ ID NO: 250 - protein, 114 aa, Artificial Sequence; identical to SEQ ID NO: 188
  Description of Artificial Sequence: Synthetic polypeptide
  XENP022634 Chain 2

SEQ ID NO: 251 - protein, 299 aa, Artificial Sequence
  Description of Artificial Sequence: Synthetic polypeptide
  XENP022635 Chain 1
ITCPPPMSVEHADIWVKSYSLYSRERYICNSGFKRKAGTSSLTECVLNKATNVAHWTTPSLKCIRDCAEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 252 - protein, 68 aa, Artificial Sequence; identical to SEQ ID NO: 198
  Description of Artificial Sequence: Synthetic polypeptide
  XENP022635 Human IL15Ralpha (sushi)

SEQ ID NO: 253 - protein, 231 aa, Artificial Sequence; identical to SEQ ID NO: 65
  Description of Artificial Sequence: Synthetic polypeptide
  Fc Chain of XENP022635

SEQ ID NO: 254 - protein, 114 aa, Artificial Sequence; identical to SEQ ID NO: 188
  Description of Artificial Sequence: Synthetic polypeptide
  XENP022635 Chain 2

SEQ ID NO: 255 - protein, 296 aa, Artificial Sequence
  Description of Artificial Sequence: Synthetic polypeptide
  XENP022636 Chain 1
ITCPPPMSVEHADIWVKSYSLYSRERYICNSGFKRKAGTCSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 256 - protein, 65 aa, Artificial Sequence; identical to SEQ ID NO: 199
  Description of Artificial Sequence: Synthetic polypeptide
  XENP022636 Human IL15Ralpha (sushi)

SEQ ID NO: 257 - protein, 231 aa, Artificial Sequence; identical to SEQ ID NO: 65
  Description of Artificial Sequence: Synthetic polypeptide
  Fc Chain of XENP022636

SEQ ID NO: 258 - protein, 114 aa, Artificial Sequence; identical to SEQ ID NO: 190
  Description of Artificial Sequence: Synthetic polypeptide
  XENP022636 Chain 2

SEQ ID NO: 259 - protein, 299 aa, Artificial Sequence; identical to SEQ ID NO: 251
  Description of Artificial Sequence: Synthetic polypeptide
  XENP022687 Chain 1

SEQ ID NO: 260 - protein, 68 aa, Artificial Sequence; identical to SEQ ID NO: 198
  Description of Artificial Sequence: Synthetic polypeptide
  XENP022687 Human IL15Ralpha (sushi)

SEQ ID NO: 261 - protein, 231 aa, Artificial Sequence; identical to SEQ ID NO: 65
  Description of Artificial Sequence: Synthetic polypeptide
  Fc Chain of XENP022687

SEQ ID NO: 262 - protein, 114 aa, Artificial Sequence; identical to SEQ ID NO: 188
  Description of Artificial Sequence: Synthetic polypeptide
  XENP022687 Chain 2

SEQ ID NO: 263 - protein, 308 aa, Artificial Sequence
  Description of Artificial Sequence: Synthetic polypeptide
  XENP022639 Chain 1
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRDC

SEQ ID NO: 264 - protein, 231 aa, Artificial Sequence; identical to SEQ ID NO: 44
  Description of Artificial Sequence: Synthetic polypeptide
  Fc Chain of XENP022639

SEQ ID NO: 265 - protein, 67 aa, Artificial Sequence; identical to SEQ ID NO: 196
  Description of Artificial Sequence: Synthetic polypeptide
  XENP022639 IL15Ralpha(sushi)

SEQ ID NO: 266 - protein, 231 aa, Artificial Sequence; identical to SEQ ID NO: 68
  Description of Artificial Sequence: Synthetic polypeptide
  XENP022639 Chain 2

SEQ ID NO: 267 - protein, 114 aa, Artificial Sequence; identical to SEQ ID NO: 188
  Description of Artificial Sequence: Synthetic polypeptide
  XENP022639 Chain 3

SEQ ID NO: 268 - protein, 114 aa, Artificial Sequence; identical to SEQ ID NO: 188
  Description of Artificial Sequence: Synthetic polypeptide
  XENP022640 Chain 1

SEQ ID NO: 269 - protein, 231 aa, Artificial Sequence; identical to SEQ ID NO: 44
  Description of Artificial Sequence: Synthetic polypeptide
  XENP022640 Chain 2

SEQ ID NO: 270 - protein, 114 aa, Artificial Sequence
  Description of Artificial Sequence: Synthetic polypeptide
  N1D
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 271 - protein, 114 aa, Artificial Sequence
  Description of Artificial Sequence: Synthetic polypeptide
  N4D
NWVDVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 272 - protein, 114 aa, Artificial Sequence
  Description of Artificial Sequence: Synthetic polypeptide
  D8N
NWVNVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 273 - protein, 114 aa, Artificial Sequence
  Description of Artificial Sequence: Synthetic polypeptide
  D30N
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTS

SEQ ID NO: 274 - protein, 114 aa, Artificial Sequence; identical to SEQ ID NO: 144
  Description of Artificial Sequence: Synthetic polypeptide
  D61N

SEQ ID NO: 275 - protein, 114 aa, Artificial Sequence
  Description of Artificial Sequence: Synthetic polypeptide
  E64Q
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 276 - protein, 114 aa, Artificial Sequence
  Description of Artificial Sequence: Synthetic polypeptide
  N65D
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 277 - protein, 114 aa, Artificial Sequence
  Description of Artificial Sequence: Synthetic polypeptide
  Q108E
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTS

SEQ ID NO: 278 - protein, 114 aa, Artificial Sequence
  Description of Artificial Sequence: Synthetic polypeptide
  N1D/D61N
DWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 279 - protein, 114 aa, Artificial Sequence
  Description of Artificial Sequence: Synthetic polypeptide
  N1D/E64Q
DWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 280 - protein, 114 aa, Artificial Sequence
  Description of Artificial Sequence: Synthetic polypeptide
  N4D/D61N
NWVDVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 281 - protein, 114 aa, Artificial Sequence
  Description of Artificial Sequence: Synthetic polypeptide
  N4D/E64Q
NWVDVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 282 - protein, 114 aa, Artificial Sequence
  Description of Artificial Sequence: Synthetic polypeptide
  D8N/D61N
NWVNVISNLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 283 - protein, 114 aa, Artificial Sequence
  Description of Artificial Sequence: Synthetic polypeptide
  D8N/E64Q
NWVNVISNLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 284 - protein, 114 aa, Artificial Sequence
  Description of Artificial Sequence: Synthetic polypeptide
  D61N/E64Q
NWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVQMFINTS

SEQ ID NO: 285 - protein, 114 aa, Artificial Sequence
  Description of Artificial Sequence: Synthetic polypeptide
  E64Q/Q108E
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVEMFINTS

SEQ ID NO: 286 - protein, 114 aa, Artificial Sequence
  Description of Artificial Sequence: Synthetic polypeptide
  N1D/N4D/D8N
DWVDVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 287 - protein, 114 aa, Artificial Sequence
  Description of Artificial Sequence: Synthetic polypeptide
  D61N/E64Q/N65D
NWVNVISDLKKIEDLIQSMHIDATLYTESDVHPSCKVTAMKCFLLELQVISLESGDASIHNTVQDLIILANNSLSSNGNVTESGCKECEELEEKNIKEFLQSFVHIVQMFINTS

SEQ ID NO: 288 - protein, 114 aa, Artificial Sequence
  Description of Artificial Sequence: Synthetic polypeptide
  N1D/D61N/E64Q/Q108E
DWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTS

SEQ ID NO: 289 - protein, 114 aa, Artificial Sequence
  Description of Artificial Sequence: Synthetic polypeptide
  N4D/D61N/E64Q/Q108E
NWVDVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTS

SEQ ID NO: 290 - protein, 114 aa, Artificial Sequence
  Description of Artificial Sequence: Synthetic polypeptide
  N1D/N65D
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 291 - protein, 114 aa, Artificial Sequence
  Description of Artificial Sequence: Synthetic polypeptide
  N1D/Q108E
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTS

SEQ ID NO: 292 - protein, 114 aa, Artificial Sequence; identical to SEQ ID NO: 99
  Description of Artificial Sequence: Synthetic polypeptide
  N4D/N65D

SEQ ID NO: 293 - protein, 114 aa, Artificial Sequence
  Description of Artificial Sequence: Synthetic polypeptide
  D30N/N65D
NWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTS

SEQ ID NO: 294 - protein, 114 aa, Artificial Sequence
  Description of Artificial Sequence: Synthetic polypeptide
  D30N/Q108E
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVEMFINTS

SEQ ID NO: 295 - protein, 114 aa, Artificial Sequence
  Description of Artificial Sequence: Synthetic polypeptide
  N65D/Q108E
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVEMFINTS

SEQ ID NO: 296 - protein, 114 aa, Artificial Sequence
  Description of Artificial Sequence: Synthetic polypeptide
  E64Q/N65D
NWVNVISDLKKIEDLIQSMHIDATLYTESDVHPSCKVTAMKCFLLELQVISLESGDASIHDTVQDLIILANNSLSSNGNVTESGCKECEELEEKNIKEFLQSFVHIVQMFINTS

SEQ ID NO: 297 - protein, 114 aa, Artificial Sequence
  Description of Artificial Sequence: Synthetic polypeptide
  N1D/N4D/N65D
DWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 298 - protein, 114 aa, Artificial Sequence
  Description of Artificial Sequence: Synthetic polypeptide
  D30N/E64Q/N65D
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTS

SEQ ID NO: 299 - protein, 114 aa, Artificial Sequence
  Description of Artificial Sequence: Synthetic polypeptide
  N4D/D61N/N65D
NWVDVISDLKKIEDLIQSMHIDATLYTESDVHPSCKVTAMKCFLLELQVISLESGDASIHNTVEDLIILANNSLSSNGNVTESGCKECEELEEKNIKEFLQSFVHIVQMFINTS

SEQ ID NO: 300 - protein, 350 aa, Artificial Sequence
  Description of Artificial Sequence: Synthetic polypeptide
  XENP022821 Chain 1
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 301 - protein, 114 aa, Artificial Sequence; identical to SEQ ID NO: 276
  Description of Artificial Sequence: Synthetic polypeptide
  XENP022821 Human IL15

SEQ ID NO: 302 - protein, 231 aa, Artificial Sequence; identical to SEQ ID NO: 44
  Description of Artificial Sequence: Synthetic polypeptide
  Fc Chain of XENP022821

SEQ ID NO: 303 - protein, 301 aa, Artificial Sequence; identical to SEQ ID NO: 123
  Description of Artificial Sequence: Synthetic polypeptide
  XENP022821 Chain 2

SEQ ID NO: 304 - protein, 65 aa, Artificial Sequence; identical to SEQ ID NO: 4
  Description of Artificial Sequence: Synthetic polypeptide
  XENP022821 Human IL15Ralpha (sushi)

SEQ ID NO: 305 - protein, 231 aa, Artificial Sequence; identical to SEQ ID NO: 43
  Description of Artificial Sequence: Synthetic polypeptide
  Fc Chain of XENP022821

SEQ ID NO: 306 - protein, 350 aa, Artificial Sequence
  Description of Artificial Sequence: Synthetic polypeptide
  XENP022822 Chain 1
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 307 - protein, 114 aa, Artificial Sequence; identical to SEQ ID NO: 277
  Description of Artificial Sequence: Synthetic polypeptide
  XENP022822 Human IL15

SEQ ID NO: 308 - protein, 231 aa, Artificial Sequence; identical to SEQ ID NO: 44
  Description of Artificial Sequence: Synthetic polypeptide
  Fc Chain of XENP022822

SEQ ID NO: 309 - protein, 301 aa, Artificial Sequence; identical to SEQ ID NO: 123
  Description of Artificial Sequence: Synthetic polypeptide
  XENP022822 Chain 2

SEQ ID NO: 310 - protein, 65 aa, Artificial Sequence; identical to SEQ ID NO: 4
  Description of Artificial Sequence: Synthetic polypeptide
  XENP022822 Human IL15Ralpha (sushi)

SEQ ID NO: 311 - protein, 231 aa, Artificial Sequence; identical to SEQ ID NO: 43
  Description of Artificial Sequence: Synthetic polypeptide
  Fc Chain of XENP022822

SEQ ID NO: 312 - protein, 350 aa, Artificial Sequence
  Description of Artificial Sequence: Synthetic polypeptide
  XENP23343 Chain 1
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 313 - protein, 114 aa, Artificial Sequence; identical to SEQ ID NO: 276
  Description of Artificial Sequence: Synthetic polypeptide
  XENP23343 Human IL15

SEQ ID NO: 314 - protein, 231 aa, Artificial Sequence; identical to SEQ ID NO: 64
  Description of Artificial Sequence: Synthetic polypeptide
  Fc Chain of XENP23343

SEQ ID NO: 315 - protein, 301 aa, Artificial Sequence
  Description of Artificial Sequence: Synthetic polypeptide
  XENP23343 Chain 2
ITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 316 - protein, 65 aa, Artificial Sequence; identical to SEQ ID NO: 4
  Description of Artificial Sequence: Synthetic polypeptide
  XENP23343 Human IL15Ralpha (sushi)

SEQ ID NO: 317 - protein, 231 aa, Artificial Sequence; identical to SEQ ID NO: 63
  Description of Artificial Sequence: Synthetic polypeptide
  Fc Chain of XENP23343

SEQ ID NO: 318 - protein, 350 aa, Artificial Sequence
  Description of Artificial Sequence: Synthetic polypeptide
  XENP023554 Chain 1
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 319 - protein, 114 aa, Artificial Sequence; identical to SEQ ID NO: 290
  Description of Artificial Sequence: Synthetic polypeptide
  XENP023554 Human IL15

SEQ ID NO: 320 - protein, 231 aa, Artificial Sequence; identical to SEQ ID NO: 44
  Description of Artificial Sequence: Synthetic polypeptide
  Fc Chain of XENP023554

SEQ ID NO: 321 - protein, 301 aa, Artificial Sequence; identical to SEQ ID NO: 123
  Description of Artificial Sequence: Synthetic polypeptide
  XENP023554 Chain 2

SEQ ID NO: 322 - protein, 65 aa, Artificial Sequence; identical to SEQ ID NO: 4
  Description of Artificial Sequence: Synthetic polypeptide
  XENP023554 Human IL15Ralpha (sushi)

SEQ ID NO: 323 - protein, 231 aa, Artificial Sequence; identical to SEQ ID NO: 43
  Description of Artificial Sequence: Synthetic polypeptide
  Fc Chain of XENP023554

SEQ ID NO: 324 - protein, 350 aa, Artificial Sequence
  Description of Artificial Sequence: Synthetic polypeptide
  XENP023557 Chain 1
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 325 - protein, 114 aa, Artificial Sequence; identical to SEQ ID NO: 99
  Description of Artificial Sequence: Synthetic polypeptide
  XENP023557 Human IL15

SEQ ID NO: 326 - protein, 231 aa, Artificial Sequence; identical to SEQ ID NO: 44
  Description of Artificial Sequence: Synthetic polypeptide
  Fc Chain of XENP023557

SEQ ID NO: 327 - protein, 301 aa, Artificial Sequence; identical to SEQ ID NO: 123
  Description of Artificial Sequence: Synthetic polypeptide
  XENP023557 Chain 2

SEQ ID NO: 328 - protein, 65 aa, Artificial Sequence; identical to SEQ ID NO: 4
  Description of Artificial Sequence: Synthetic polypeptide
  XENP023557 Human IL15Ralpha (sushi)

SEQ ID NO: 329 - protein, 231 aa, Artificial Sequence; identical to SEQ ID NO: 43
  Description of Artificial Sequence: Synthetic polypeptide
  Fc Chain of XENP023557

SEQ ID NO: 330 - protein, 350 aa, Artificial Sequence
  Description of Artificial Sequence: Synthetic polypeptide
  XENP023561 Chain 1
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 331 - protein, 114 aa, Artificial Sequence; identical to SEQ ID NO: 295
  Description of Artificial Sequence: Synthetic polypeptide
  XENP023561 Human IL15

SEQ ID NO: 332 - protein, 231 aa, Artificial Sequence; identical to SEQ ID NO: 44
  Description of Artificial Sequence: Synthetic polypeptide
  Fc Chain of XENP023561

SEQ ID NO: 333 - protein, 301 aa, Artificial Sequence; identical to SEQ ID NO: 123
  Description of Artificial Sequence: Synthetic polypeptide
  XENP023561 Chain 2

SEQ ID NO: 334 - protein, 65 aa, Artificial Sequence; identical to SEQ ID NO: 4
  Description of Artificial Sequence: Synthetic polypeptide
  XENP023561 Human IL15Ralpha (sushi)

SEQ ID NO: 335 - protein, 231 aa, Artificial Sequence; identical to SEQ ID NO: 43
  Description of Artificial Sequence: Synthetic polypeptide
  Fc Chain of XENP023561

SEQ ID NO: 336 - protein, 345 aa, Artificial Sequence
  Description of Artificial Sequence: Synthetic polypeptide
  XENP024018 Chain 1
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 337 - protein, 114 aa, Artificial Sequence; identical to SEQ ID NO: 276
  Description of Artificial Sequence: Synthetic polypeptide
  XENP024018 Human IL15

SEQ ID NO: 338 - protein, 231 aa, Artificial Sequence; identical to SEQ ID NO: 44
  Description of Artificial Sequence: Synthetic polypeptide
  Fc Chain of XENP024018

SEQ ID NO: 339 - protein, 296 aa, Artificial Sequence; identical to SEQ ID NO: 129
  Description of Artificial Sequence: Synthetic polypeptide
  XENP024018 Chain 2

SEQ ID NO: 340 - protein, 65 aa, Artificial Sequence; identical to SEQ ID NO: 4
  Description of Artificial Sequence: Synthetic polypeptide
  XENP024018 Human IL15Ralpha (sushi)

SEQ ID NO: 341 - protein, 231 aa, Artificial Sequence; identical to SEQ ID NO: 43
  Description of Artificial Sequence: Synthetic polypeptide
  Fc Chain of XENP024018

SEQ ID NO: 342 - protein, 345 aa, Artificial Sequence
  Description of Artificial Sequence: Synthetic polypeptide
  XENP024019 Chain 1
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 343 - protein, 114 aa, Artificial Sequence; identical to SEQ ID NO: 277
  Description of Artificial Sequence: Synthetic polypeptide
  XENP024019 Human IL15

SEQ ID NO: 344 - protein, 231 aa, Artificial Sequence; identical to SEQ ID NO: 44
  Description of Artificial Sequence: Synthetic polypeptide
  Fc Chain of XENP024019

SEQ ID NO: 345 - protein, 296 aa, Artificial Sequence; identical to SEQ ID NO: 129
  Description of Artificial Sequence: Synthetic polypeptide
  XENP024019 Chain 2

SEQ ID NO: 346 - protein, 65 aa, Artificial Sequence; identical to SEQ ID NO: 4
  Description of Artificial Sequence: Synthetic polypeptide
  XENP024019 Human IL15Ralpha (sushi)

SEQ ID NO: 347 - protein, 231 aa, Artificial Sequence; identical to SEQ ID NO: 43
  Description of Artificial Sequence: Synthetic polypeptide
  Fc Chain of XENP024019

SEQ ID NO: 348 - protein, 350 aa, Artificial Sequence
  Description of Artificial Sequence: Synthetic polypeptide
  XENP024045 Chain 1
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 349 - protein, 114 aa, Artificial Sequence; identical to SEQ ID NO: 298
  Description of Artificial Sequence: Synthetic polypeptide
  XENP024045 Human IL15

SEQ ID NO: 350 - protein, 231 aa, Artificial Sequence; identical to SEQ ID NO: 44
  Description of Artificial Sequence: Synthetic polypeptide
  Fc Chain of XENP024045

SEQ ID NO: 351 - protein, 301 aa, Artificial Sequence; identical to SEQ ID NO: 123
  Description of Artificial Sequence: Synthetic polypeptide
  XENP024045 Chain 2

SEQ ID NO: 352 - protein, 65 aa, Artificial Sequence; identical to SEQ ID NO: 4
  Description of Artificial Sequence: Synthetic polypeptide
  XENP024045 Human IL15Ralpha (sushi)

SEQ ID NO: 353 - protein, 231 aa, Artificial Sequence; identical to SEQ ID NO: 43
  Description of Artificial Sequence: Synthetic polypeptide
  Fc Chain of XENP024045

SEQ ID NO: 354 - protein, 345 aa, Artificial Sequence
  Description of Artificial Sequence: Synthetic polypeptide
  XENP024051 Chain 1
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 355 - protein, 114 aa, Artificial Sequence; identical to SEQ ID NO: 290
  Description of Artificial Sequence: Synthetic polypeptide
  XENP024051 Human IL15

SEQ ID NO: 356 - protein, 231 aa, Artificial Sequence; identical to SEQ ID NO: 44
  Description of Artificial Sequence: Synthetic polypeptide
  Fc Chain of XENP024051

SEQ ID NO: 357 - protein, 296 aa, Artificial Sequence; identical to SEQ ID NO: 129
  Description of Artificial Sequence: Synthetic polypeptide
  XENP024051 Chain 2

SEQ ID NO: 358 - protein, 65 aa, Artificial Sequence; identical to SEQ ID NO: 4
  Description of Artificial Sequence: Synthetic polypeptide
  XENP024051 Human IL15Ralpha (sushi)

SEQ ID NO: 359 - protein, 231 aa, Artificial Sequence; identical to SEQ ID NO: 43
  Description of Artificial Sequence: Synthetic polypeptide
  Fc Chain of XENP024051

SEQ ID NO: 360 - protein, 345 aa, Artificial Sequence
  Description of Artificial Sequence: Synthetic polypeptide
  XENP024052 Chain 1
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 361 - protein, 114 aa, Artificial Sequence; identical to SEQ ID NO: 99
  Description of Artificial Sequence: Synthetic polypeptide
  XENP024052 Human IL15

SEQ ID NO: 362 - protein, 231 aa, Artificial Sequence; identical to SEQ ID NO: 44
  Description of Artificial Sequence: Synthetic polypeptide
  Fc Chain of XENP024052

SEQ ID NO: 363 - protein, 296 aa, Artificial Sequence; identical to SEQ ID NO: 129
  Description of Artificial Sequence: Synthetic polypeptide
  XENP024052 Chain 2

SEQ ID NO: 364 - protein, 65 aa, Artificial Sequence; identical to SEQ ID NO: 4
  Description of Artificial Sequence: Synthetic polypeptide
  XENP024052 Human IL15Ralpha (sushi)

SEQ ID NO: 365 - protein, 231 aa, Artificial Sequence; identical to SEQ ID NO: 43
  Description of Artificial Sequence: Synthetic polypeptide
  Fc Chain of XENP024052

SEQ ID NO: 366 - protein, 350 aa, Artificial Sequence
  Description of Artificial Sequence: Synthetic polypeptide
  XENP24306 Chain 1
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 367 - protein, 114 aa, Artificial Sequence; identical to SEQ ID NO: 298
  Description of Artificial Sequence: Synthetic polypeptide
  XENP24306 Human IL15

SEQ ID NO: 368 - protein, 231 aa, Artificial Sequence; identical to SEQ ID NO: 64
  Description of Artificial Sequence: Synthetic polypeptide
  Fc Chain of XENP24306

SEQ ID NO: 369 - protein, 301 aa, Artificial Sequence; identical to SEQ ID NO: 315
  Description of Artificial Sequence: Synthetic polypeptide
  XENP24306 Chain 2

SEQ ID NO: 370 - protein, 65 aa, Artificial Sequence; identical to SEQ ID NO: 4
  Description of Artificial Sequence: Synthetic polypeptide
  XENP24306 Human IL15Ralpha (sushi)

SEQ ID NO: 371 - protein, 231 aa, Artificial Sequence; identical to SEQ ID NO: 63
  Description of Artificial Sequence: Synthetic polypeptide
  Fc Chain of XENP24306

SEQ ID NO: 372 - protein, 435 aa, Artificial Sequence; identical to SEQ ID NO: 142
  Description of Artificial Sequence: Synthetic polypeptide
  XENP24013 Chain 1

SEQ ID NO: 373 - protein, 65 aa, Artificial Sequence; identical to SEQ ID NO: 4
  Description of Artificial Sequence: Synthetic polypeptide
  XENP24013 Human IL15Ralpha (sushi)

SEQ ID NO: 374 - protein, 114 aa, Artificial Sequence; identical to SEQ ID NO: 144
  Description of Artificial Sequence: Synthetic polypeptide
  XENP24013 Human IL15

SEQ ID NO: 375 - protein, 231 aa, Artificial Sequence; identical to SEQ ID NO: 44
  Description of Artificial Sequence: Synthetic polypeptide
  Fc Chain of XENP24013

SEQ ID NO: 376 - protein, 231 aa, Artificial Sequence; identical to SEQ ID NO: 43
  Description of Artificial Sequence: Synthetic polypeptide
  XENP24013 Chain 2

SEQ ID NO: 377 - protein, 435 aa, Artificial Sequence
  Description of Artificial Sequence: Synthetic polypeptide
  XENP24014 Chain 1
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 378 - protein, 65 aa, Artificial Sequence; identical to SEQ ID NO: 4
  Description of Artificial Sequence: Synthetic polypeptide
  XENP24014 Human IL15Ralpha (sushi)

SEQ ID NO: 379 - protein, 114 aa, Artificial Sequence; identical to SEQ ID NO: 276
  Description of Artificial Sequence: Synthetic polypeptide
  XENP24014 Human IL15

SEQ ID NO: 380 - protein, 231 aa, Artificial Sequence; identical to SEQ ID NO: 44
  Description of Artificial Sequence: Synthetic polypeptide
  Fc Chain of XENP24014

SEQ ID NO: 381 - protein, 231 aa, Artificial Sequence; identical to SEQ ID NO: 43
  Description of Artificial Sequence: Synthetic polypeptide
  XENP24014 Chain 2

SEQ ID NO: 382 - protein, 435 aa, Artificial Sequence
  Description of Artificial Sequence: Synthetic polypeptide
  XENP024015 Chain 1
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 383 - protein, 65 aa, Artificial Sequence; identical to SEQ ID NO: 4
  Description of Artificial Sequence: Synthetic polypeptide
  XENP024015 Human IL15Ralpha (sushi)

SEQ ID NO: 384 - protein, 114 aa, Artificial Sequence; identical to SEQ ID NO: 277
  Description of Artificial Sequence: Synthetic polypeptide
  XENP024015 Human IL15

SEQ ID NO: 385 - protein, 231 aa, Artificial Sequence; identical to SEQ ID NO: 44
  Description of Artificial Sequence: Synthetic polypeptide
  Fc Chain of XENP024015

SEQ ID NO: 386 - protein, 231 aa, Artificial Sequence; identical to SEQ ID NO: 43
  Description of Artificial Sequence: Synthetic polypeptide
  XENP024015 Chain 2

SEQ ID NO: 387 - protein, 435 aa, Artificial Sequence; identical to SEQ ID NO: 97
  Description of Artificial Sequence: Synthetic polypeptide
  XENP024050 Chain 1

SEQ ID NO: 388 - protein, 65 aa, Artificial Sequence; identical to SEQ ID NO: 4
  Description of Artificial Sequence: Synthetic polypeptide
  XENP024050 Human IL15Ralpha (sushi)

SEQ ID NO: 389 - protein, 114 aa, Artificial Sequence; identical to SEQ ID NO: 99
  Description of Artificial Sequence: Synthetic polypeptide
  XENP024050 Human IL15

SEQ ID NO: 390 - protein, 231 aa, Artificial Sequence; identical to SEQ ID NO: 44
  Description of Artificial Sequence: Synthetic polypeptide
  Fc Chain of XENP024050

SEQ ID NO: 391 - protein, 231 aa, Artificial Sequence; identical to SEQ ID NO: 43
  Description of Artificial Sequence: Synthetic polypeptide
  XENP024050 Chain 2

SEQ ID NO: 392 - protein, 435 aa, Artificial Sequence
  Description of Artificial Sequence: Synthetic polypeptide
  XENP24294 Chain 1
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 393 - protein, 65 aa, Artificial Sequence; identical to SEQ ID NO: 4
  Description of Artificial Sequence: Synthetic polypeptide
  XENP24294 Human IL15Ralpha (sushi)

SEQ ID NO: 394 - protein, 114 aa, Artificial Sequence; identical to SEQ ID NO: 99
  Description of Artificial Sequence: Synthetic polypeptide
  XENP24294 Human IL15

SEQ ID NO: 395 - protein, 231 aa, Artificial Sequence; identical to SEQ ID NO: 64
  Description of Artificial Sequence: Synthetic polypeptide
  Fc Chain of XENP24294

SEQ ID NO: 396 - protein, 231 aa, Artificial Sequence; identical to SEQ ID NO: 63
  Description of Artificial Sequence: Synthetic polypeptide
  XENP24294 Chain 2

SEQ ID NO: 397 - protein, 440 aa, Artificial Sequence
  Description of Artificial Sequence: Synthetic polypeptide
  XENP024475 Chain 1
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 398 - protein, 65 aa, Artificial Sequence; identical to SEQ ID NO: 4
  Description of Artificial Sequence: Synthetic polypeptide
  XENP024475 Human IL15Ralpha (sushi)

SEQ ID NO: 399 - protein, 114 aa, Artificial Sequence; identical to SEQ ID NO: 277
  Description of Artificial Sequence: Synthetic polypeptide
  XENP024475 Human IL15

SEQ ID NO: 400 - protein, 231 aa, Artificial Sequence; identical to SEQ ID NO: 44
  Description of Artificial Sequence: Synthetic polypeptide
  Fc Chain of XENP024475

SEQ ID NO: 401 - protein, 231 aa, Artificial Sequence; identical to SEQ ID NO: 43
  Description of Artificial Sequence: Synthetic polypeptide
  XENP024475 Chain 2

SEQ ID NO: 402 - protein, 440 aa, Artificial Sequence
  Description of Artificial Sequence: Synthetic polypeptide
  XENP024476 Chain 1
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 403 - protein, 65 aa, Artificial Sequence; identical to SEQ ID NO: 4
  Description of Artificial Sequence: Synthetic polypeptide
  XENP024476 Human IL15Ralpha (sushi)

SEQ ID NO: 404 - protein, 114 aa, Artificial Sequence; identical to SEQ ID NO: 99
  Description of Artificial Sequence: Synthetic polypeptide
  XENP024476 Human IL15

SEQ ID NO: 405 - protein, 231 aa, Artificial Sequence; identical to SEQ ID NO: 44
  Description of Artificial Sequence: Synthetic polypeptide
  Fc Chain of XENP024476

SEQ ID NO: 406 - protein, 231 aa, Artificial Sequence; identical to SEQ ID NO: 43
  Description of Artificial Sequence: Synthetic polypeptide
  XENP024476 Chain 2

SEQ ID NO: 407 - protein, 445 aa, Artificial Sequence
  Description of Artificial Sequence: Synthetic polypeptide
  XENP024478 Chain 1
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 408 - protein, 65 aa, Artificial Sequence; identical to SEQ ID NO: 4
  Description of Artificial Sequence: Synthetic polypeptide
  XENP024478 Human IL15Ralpha (sushi)

SEQ ID NO: 409 - protein, 114 aa, Artificial Sequence; identical to SEQ ID NO: 277
  Description of Artificial Sequence: Synthetic polypeptide
  XENP024478 Human IL15

SEQ ID NO: 410 - protein, 231 aa, Artificial Sequence; identical to SEQ ID NO: 44
  Description of Artificial Sequence: Synthetic polypeptide
  Fc Chain of XENP024478

SEQ ID NO: 411 - protein, 231 aa, Artificial Sequence; identical to SEQ ID NO: 43
  Description of Artificial Sequence: Synthetic polypeptide
  XENP024478 Chain 2

SEQ ID NO: 412 - protein, 445 aa, Artificial Sequence
  Description of Artificial Sequence: Synthetic polypeptide
  XENP024479 Chain 1
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 413 - protein, 65 aa, Artificial Sequence; identical to SEQ ID NO: 4
  Description of Artificial Sequence: Synthetic polypeptide
  XENP024479 Human IL15Ralpha (sushi)

SEQ ID NO: 414 - protein, 114 aa, Artificial Sequence; identical to SEQ ID NO: 99
  Description of Artificial Sequence: Synthetic polypeptide
  XENP024479 Human IL15

SEQ ID NO: 415 - protein, 231 aa, Artificial Sequence; identical to SEQ ID NO: 44
  Description of Artificial Sequence: Synthetic polypeptide
  Fc Chain of XENP024479

SEQ ID NO: 416 - protein, 231 aa, Artificial Sequence; identical to SEQ ID NO: 43
  Description of Artificial Sequence: Synthetic polypeptide
  XENP024479 Chain 2

SEQ ID NO: 417 - protein, 440 aa, Artificial Sequence
  Description of Artificial Sequence: Synthetic polypeptide
  XENP024481 Chain 1
ITCPPPMSVEHADIWVKSYSLYSRERYICNSGFKRKAGTSSLTECVLNKATNVAHWTTPSLKCIRDPALVHQRPAPPGGGGSGGGGSGGGGSGGGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 418 - protein, 65 aa, Artificial Sequence; identical to SEQ ID NO: 4
  Description of Artificial Sequence: Synthetic polypeptide
  XENP024481 Human IL15Ralpha (sushi)

SEQ ID NO: 419 - protein, 114 aa, Artificial Sequence; identical to SEQ ID NO: 277
  Description of Artificial Sequence: Synthetic polypeptide
  XENP024481 Human IL15

SEQ ID NO: 420 - protein, 231 aa, Artificial Sequence; identical to SEQ ID NO: 44
  Description of Artificial Sequence: Synthetic polypeptide
  Fc Chain of XENP024481

SEQ ID NO: 421 - protein, 231 aa, Artificial Sequence; identical to SEQ ID NO: 43
  Description of Artificial Sequence: Synthetic polypeptide
  XENP024481 Chain 2

SEQ ID NO: 422 - protein, 296 aa, Artificial Sequence; identical to SEQ ID NO: 158
  Description of Artificial Sequence: Synthetic polypeptide
  XENP024349 Chain 1

SEQ ID NO: 423 - protein, 65 aa, Artificial Sequence; identical to SEQ ID NO: 4
  Description of Artificial Sequence: Synthetic polypeptide
  XENP024349 Human IL15Ralpha (sushi)

SEQ ID NO: 424 - protein, 231 aa, Artificial Sequence; identical to SEQ ID NO: 44
  Description of Artificial Sequence: Synthetic polypeptide
  Fc Chain of XENP024349

SEQ ID NO: 425 - protein, 231 aa, Artificial Sequence; identical to SEQ ID NO: 43
  Description of Artificial Sequence: Synthetic polypeptide
  XENP024349 Chain 2

SEQ ID NO: 426 - protein, 114 aa, Artificial Sequence; identical to SEQ ID NO: 277
  Description of Artificial Sequence: Synthetic polypeptide
  XENP024349 Chain 3

SEQ ID NO: 427 - protein, 296 aa, Artificial Sequence; identical to SEQ ID NO: 158
  Description of Artificial Sequence: Synthetic polypeptide
  XENP024890 Chain 1

SEQ ID NO: 428 - protein, 65 aa, Artificial Sequence; identical to SEQ ID NO: 4
  Description of Artificial Sequence: Synthetic polypeptide
  XENP024890 IL15

SEQ ID NO: 429 - protein, 231 aa, Artificial Sequence; identical to SEQ ID NO: 44
  Description of Artificial Sequence: Synthetic polypeptide
  Fc Chain of XENP024890

SEQ ID NO: 430 - protein, 296 aa, Artificial Sequence; identical to SEQ ID NO: 158
  Description of Artificial Sequence: Synthetic polypeptide
  XENP024890 Chain 2

SEQ ID NO: 431 - protein, 65 aa, Artificial Sequence; identical to SEQ ID NO: 4
  Description of Artificial Sequence: Synthetic polypeptide
  XENP024890 Human IL15Ralpha (sushi)

SEQ ID NO: 432 - protein, 231 aa, Artificial Sequence; identical to SEQ ID NO: 44
  Description of Artificial Sequence: Synthetic polypeptide
  Fc Chain of XENP024890

SEQ ID NO: 433 - protein, 231 aa, Artificial Sequence; identical to SEQ ID NO: 43
  Description of Artificial Sequence: Synthetic polypeptide
  XENP024890 Chain 3

SEQ ID NO: 434 - protein, 114 aa, Artificial Sequence; identical to SEQ ID NO: 298
  Description of Artificial Sequence: Synthetic polypeptide
  XENP25138 Chain 1

SEQ ID NO: 435 - protein, 296 aa, Artificial Sequence; identical to SEQ ID NO: 158
  Description of Artificial Sequence: Synthetic polypeptide
  XENP25138 Chain 2

SEQ ID NO: 436 - protein, 65 aa, Artificial Sequence; identical to SEQ ID NO: 4
  Description of Artificial Sequence: Synthetic polypeptide
  XENP25138 Human IL15Ralpha (sushi)

SEQ ID NO: 437 - protein, 231 aa, Artificial Sequence; identical to SEQ ID NO: 44
  Description of Artificial Sequence: Synthetic polypeptide
  Fc Chain of XENP25138

SEQ ID NO: 438 - protein, 231 aa, Artificial Sequence; identical to SEQ ID NO: 43
  Description of Artificial Sequence: Synthetic polypeptide
  XENP25138 Chain 3

SEQ ID NO: 439 - protein, 114 aa, Artificial Sequence; identical to SEQ ID NO: 276
  Description of Artificial Sequence: Synthetic polypeptide
  XENP022801 Chain 1

SEQ ID NO: 440 - protein, 65 aa, Artificial Sequence; identical to SEQ ID NO: 4
  Description of Artificial Sequence: Synthetic polypeptide
  XENP022801 Chain 2

SEQ ID NO: 441 - protein, 114 aa, Artificial Sequence; identical to SEQ ID NO: 277
  Description of Artificial Sequence: Synthetic polypeptide
  XENP022802 Chain 1

SEQ ID NO: 442 - protein, 65 aa, Artificial Sequence; identical to SEQ ID NO: 4
  Description of Artificial Sequence: Synthetic polypeptide
  XENP022802 Chain 2

SEQ ID NO: 443 - protein, 296 aa, Artificial Sequence; identical to SEQ ID NO: 162
  Description of Artificial Sequence: Synthetic polypeptide
  XENP024342 Chain 1

SEQ ID NO: 444 - protein, 65 aa, Artificial Sequence; identical to SEQ ID NO: 4
  Description of Artificial Sequence: Synthetic polypeptide
  XENP024342 Human IL15Ralpha (sushi)

SEQ ID NO: 445 - protein, 231 aa, Artificial Sequence; identical to SEQ ID NO: 65
  Description of Artificial Sequence: Synthetic polypeptide
  Fc Chain of XENP024342

SEQ ID NO: 446 - protein, 114 aa, Artificial Sequence; identical to SEQ ID NO: 277
  Description of Artificial Sequence: Synthetic polypeptide
  XENP024342 Chain 2

SEQ ID NO: 447 - protein, 231 aa, Artificial Sequence; identical to SEQ ID NO: 44
  Description of Artificial Sequence: Synthetic polypeptide
  XENP023472 Chain 1

SEQ ID NO: 448 - protein, 114 aa, Artificial Sequence
  Description of Artificial Sequence: Synthetic polypeptide
  XENP023472 Chain 2
NWVNVISDLKKIEDLIQSMHIDATLYTESDVHPSCKVTAMKCFLLELQVISLESGDASIHDTVEDLIILANNSLSSNGNVTESGCKCCEELEEKNIKEFLQSFVHIVQMFINTS

SEQ ID NO: 449 - protein, 298 aa, Artificial Sequence
  Description of Artificial Sequence: Synthetic polypeptide
  XENP023472 Chain 3
ITCPPPMSVEHADIWVKSYSLYSRERYICNSGFKRKAGTSSLTECVLNKATNVAHWTTPSLKCIRDCEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 450 - protein, 67 aa, Artificial Sequence; identical to SEQ ID NO: 196
  Description of Artificial Sequence: Synthetic polypeptide
  XENP023472 IL15Ralpha(sushi)

SEQ ID NO: 451 - protein, 231 aa, Artificial Sequence; identical to SEQ ID NO: 43
  Description of Artificial Sequence: Synthetic polypeptide
  Fc Chain of XENP023472

SEQ ID NO: 452 - protein, 231 aa, Artificial Sequence; identical to SEQ ID NO: 44
  Description of Artificial Sequence: Synthetic polypeptide
  XENP023473 Chain 1

SEQ ID NO: 453 - protein, 114 aa, Artificial Sequence
  Description of Artificial Sequence: Synthetic polypeptide
  XENP023473 Chain 2
NWVNVISDLKKIEDLIQSMHIDATLYTESDVHPSCKVTAMKCFLLELQVISCESGDASIHDTVEDLIILANNSLSSNGNVTESGCKECEELEEKNIKEFLQSFVHIVQMFINTS

SEQ ID NO: 454 - protein, 296 aa, Artificial Sequence
  Description of Artificial Sequence: Synthetic polypeptide
  XENP023473 Chain 3
ITCPPPMSVEHADIWVKSYSLYSRERYICNSGFKRKAGTCSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 455 - protein, 65 aa, Artificial Sequence; identical to SEQ ID NO: 199
  Description of Artificial Sequence: Synthetic polypeptide
  XENP023473 IL15Ralpha(sushi)

SEQ ID NO: 456 - protein, 231 aa, Artificial Sequence; identical to SEQ ID NO: 43
  Description of Artificial Sequence: Synthetic polypeptide
  Fc Chain of XENP023473

SEQ ID NO: 457 - protein, 454 aa, Artificial Sequence
  Description of Artificial Sequence: Synthetic polypeptide
  XENP024541 Chain 1
QVQLVQSGAEVKKPGASVKVSCKASGYTFTSYWMNWVRQAPGQGLEWMGRIDPYDSETHYAQKLQGRVTMTTDTSTSTAYMELRSLRSDDTAVYYCARGGYDFDVGTLYWFFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 458 - protein, 125 aa, Artificial Sequence
  Description of Artificial Sequence: Synthetic polypeptide
  VH of XENP024541
QVQLVQSGAEVKKPGASVKVSCKASGYTFTSYWMNWVRQAPGQGLEWMGRIDPYDSETHYAQKLQGRVTMTTDTSTSTAYMELRSLRSDDTAVYYCARGGYDFDVGTLYWFFDVWGQGTTVTVSS

SEQ ID NO: 459 - protein, 5 aa, Artificial Sequence
  Description of Artificial Sequence: Synthetic peptide
  XENP024541 vhCDR1
SYWMN

SEQ ID NO: 460 - protein, 17 aa, Artificial Sequence
  Description of Artificial Sequence: Synthetic peptide
  XENP024541 vhCDR2
RIDPYDSETHYAQKLQG

SEQ ID NO: 461 - protein, 16 aa, Artificial Sequence
  Description of Artificial Sequence: Synthetic peptide
  XENP024541 vhCDR3
GGYDFDVGTLYWFFDV

SEQ ID NO: 462 - protein, 214 aa, Artificial Sequence
  Description of Artificial Sequence: Synthetic polypeptide
  XENP024541 Chain 2
DIQMTQSPSSLSASVGDRVTITCRASENIYSYLAWYQQKPGKAPKLLIYNAKTLAEGVPSRFSGSGSGTDFTLTISSLQPEDFATYYCQHHYGTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 463 - protein, 107 aa, Artificial Sequence
  Description of Artificial Sequence: Synthetic polypeptide
  VL of XENP024541
DIQMTQSPSSLSASVGDRVTITCRASENIYSYLAWYQQKPGKAPKLLIYNAKTLAEGVPSRFSGSGSGTDFTLTISSLQPEDFATYYCQHHYGTPRTFGGGTKVEIK

SEQ ID NO: 464 - protein, 11 aa, Artificial Sequence
  Description of Artificial Sequence: Synthetic peptide
  XENP024541 vlCDR1
RASENIYSYLA

SEQ ID NO: 465 - protein, 7 aa, Artificial Sequence
  Description of Artificial Sequence: Synthetic peptide
  XENP024541 vlCDR2
NAKTLAE

SEQ ID NO: 466 - protein, 9 aa, Artificial Sequence
  Description of Artificial Sequence: Synthetic peptide
  XENP024541 vlCDR3
QHHYGTPRT

SEQ ID NO: 467 - protein, 454 aa, Artificial Sequence
  Description of Artificial Sequence: Synthetic polypeptide
  XENP024542 Chain 1
QVQLQQPGAELVRPGASVKLSCKASGYTFTSYWMNWVKQRPEQGLQWIGRIDPYDSETHYSQKFKDKAILTVDKSSSTAYMRLSSLTSEDSAVYYCARGGYDFDVGTLYWFFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 468 - protein, 125 aa, Artificial Sequence
  Description of Artificial Sequence: Synthetic polypeptide
  VH of XENP024542
QVQLQQPGAELVRPGASVKLSCKASGYTFTSYWMNWVKQRPEQGLQWIGRIDPYDSETHYSQKFKDKAILTVDKSSSTAYMRLSSLTSEDSAVYYCARGGYDFDVGTLYWFFDVWGAGTTVTVSS

SEQ ID NO: 469 - protein, 5 aa, Artificial Sequence
  Description of Artificial Sequence: Synthetic peptide
  XENP024542 vhCDR1
SYWMN

SEQ ID NO: 470 - protein, 17 aa, Artificial Sequence
  Description of Artificial Sequence: Synthetic peptide
  XENP024542 vhCDR2
RIDPYDSETHYSQKFKD

SEQ ID NO: 471 - protein, 16 aa, Artificial Sequence
  Description of Artificial Sequence: Synthetic peptide
  XENP024542 vhCDR3
GGYDFDVGTLYWFFDV

SEQ ID NO: 472 - protein, 214 aa, Artificial Sequence
  Description of Artificial Sequence: Synthetic polypeptide
  XENP024542 Chain 2
DIQMTQSPASLSASVGETVTITCRASENIYSYLAWYQQKQGKSPQFLVYNAKTLAEGVPSRFSGSGSGTQFSLKINSLQPEDFGSYYCQHHYGTPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 473 - protein, 107 aa, Artificial Sequence
  Description of Artificial Sequence: Synthetic polypeptide
  VL of XENP024542
DIQMTQSPASLSASVGETVTITCRASENIYSYLAWYQQKQGKSPQFLVYNAKTLAEGVPSRFSGSGSGTQFSLKINSLQPEDFGSYYCQHHYGTPRTFGGGTKLEIK

SEQ ID NO: 474 - protein, 11 aa, Artificial Sequence
  Description of Artificial Sequence: Synthetic peptide
  XENP024542 vlCDR1
RASENIYSYLA

SEQ ID NO: 475 - protein, 7 aa, Artificial Sequence
  Description of Artificial Sequence: Synthetic peptide
  XENP024542 vlCDR2
NAKTLAE

SEQ ID NO: 476 - protein, 9 aa, Artificial Sequence
  Description of Artificial Sequence: Synthetic peptide
  XENP024542 vlCDR3
QHHYGTPRT

SEQ ID NO: 477 - protein, 444 aa, Artificial Sequence
  Description of Artificial Sequence: Synthetic polypeptide
  XENP024365 Chain 1
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 478 - protein, 115 aa, Artificial Sequence
  Description of Artificial Sequence: Synthetic polypeptide
  VH of XENP024365
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSS

SEQ ID NO: 479 - protein, 5 aa, Artificial Sequence
  Description of Artificial Sequence: Synthetic peptide
  XENP024365 vhCDR1
SYYWS

SEQ ID NO: 480 - protein, 16 aa, Artificial Sequence
  Description of Artificial Sequence: Synthetic peptide
  XENP024365 vhCDR2
HISYSGSANYNPSLKS

SEQ ID NO: 481 - protein, 7 aa, Artificial Sequence
  Description of Artificial Sequence: Synthetic peptide
  XENP024365 vhCDR3
WDDAFNI

SEQ ID NO: 482 - protein, 215 aa, Artificial Sequence
  Description of Artificial Sequence: Synthetic polypeptide
  XENP024365 Chain 2
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 483 - protein, 108 aa, Artificial Sequence
  Description of Artificial Sequence: Synthetic polypeptide
  VL of XENP024365
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 484 - protein, 12 aa, Artificial Sequence
  Description of Artificial Sequence: Synthetic peptide
  XENP024365 vlCDR1
RASQSVSSSYLA

SEQ ID NO: 485 - protein, 7 aa, Artificial Sequence
  Description of Artificial Sequence: Synthetic peptide
  XENP024365 vlCDR2
GASSRAT

SEQ ID NO: 486 - protein, 9 aa, Artificial Sequence
  Description of Artificial Sequence: Synthetic peptide
  XENP024365 vlCDR3
QQYGSSPWT

SEQ ID NO: 487 - protein, 435 aa, Artificial Sequence; identical to SEQ ID NO: 377
  Description of Artificial Sequence: Synthetic polypeptide
  XENP024531 Chain 1

SEQ ID NO: 488 - protein, 65 aa, Artificial Sequence; identical to SEQ ID NO: 4
  Description of Artificial Sequence: Synthetic polypeptide
  XENP024531 Human IL15Ralpha (sushi)

SEQ ID NO: 489 - protein, 114 aa, Artificial Sequence; identical to SEQ ID NO: 276
  Description of Artificial Sequence: Synthetic polypeptide
  XENP024531 Human IL15

SEQ ID NO: 490 - protein, 231 aa, Artificial Sequence; identical to SEQ ID NO: 44
  Description of Artificial Sequence: Synthetic polypeptide
  Fc Chain of XENP024531

SEQ ID NO: 491 - protein, 454 aa, Artificial Sequence
  Description of Artificial Sequence: Synthetic polypeptide
  XENP024531 Chain 2
QVQLVQSGAEVKKPGASVKVSCKASGYTFTSYWMNWVRQAPGQGLEWMGRIDPYDSETHYAQKLQGRVTMTTDTSTSTAYMELRSLRSDDTAVYYCARGGYDFDVGTLYWFFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 492 - protein, 125 aa, Artificial Sequence; identical to SEQ ID NO: 458
  Description of Artificial Sequence: Synthetic polypeptide
  VH of XENP024531

SEQ ID NO: 493 - protein, 5 aa, Artificial Sequence
  Description of Artificial Sequence: Synthetic peptide
  XENP024531 vhCDR1
SYWMN

SEQ ID NO: 494 - protein, 17 aa, Artificial Sequence
  Description of Artificial Sequence: Synthetic peptide
  XENP024531 vhCDR2
RIDPYDSETHYAQKLQG

SEQ ID NO: 495 - protein, 16 aa, Artificial Sequence
  Description of Artificial Sequence: Synthetic peptide
  XENP024531 vhCDR3
GGYDFDVGTLYWFFDV

SEQ ID NO: 496 - protein, 214 aa, Artificial Sequence; identical to SEQ ID NO: 462
  Description of Artificial Sequence: Synthetic polypeptide
  XENP024531 Chain 3

SEQ ID NO: 497 - protein, 107 aa, Artificial Sequence; identical to SEQ ID NO: 463
  Description of Artificial Sequence: Synthetic polypeptide
  VL of XENP024531

SEQ ID NO: 498 - protein, 11 aa, Artificial Sequence
  Description of Artificial Sequence: Synthetic peptide
  XENP024531 vlCDR1
RASENIYSYLA

SEQ ID NO: 499 - protein, 7 aa, Artificial Sequence
  Description of Artificial Sequence: Synthetic peptide
  XENP024531 vlCDR2
NAKTLAE

SEQ ID NO: 500 - protein, 9 aa, Artificial Sequence
  Description of Artificial Sequence: Synthetic peptide
  XENP024531 vlCDR3
QHHYGTPRT

SEQ ID NO: 501 - protein, 435 aa, Artificial Sequence; identical to SEQ ID NO: 382
  Description of Artificial Sequence: Synthetic polypeptide
  XENP024532 Chain 1

SEQ ID NO: 502 - protein, 65 aa, Artificial Sequence; identical to SEQ ID NO: 4
  Description of Artificial Sequence: Synthetic polypeptide
  XENP024532 Human IL15Ralpha (sushi)

SEQ ID NO: 503 - protein, 114 aa, Artificial Sequence; identical to SEQ ID NO: 277
  Description of Artificial Sequence: Synthetic polypeptide
  XENP024532 Human IL15

SEQ ID NO: 504 - protein, 231 aa, Artificial Sequence; identical to SEQ ID NO: 44
  Description of Artificial Sequence: Synthetic polypeptide
  Fc Chain of XENP024532

SEQ ID NO: 505 - protein, 454 aa, Artificial Sequence; identical to SEQ ID NO: 491
  Description of Artificial Sequence: Synthetic polypeptide
  XENP024532 Chain 2

SEQ ID NO: 506 - protein, 125 aa, Artificial Sequence; identical to SEQ ID NO: 458
  Description of Artificial Sequence: Synthetic polypeptide
  VH of XENP024532

SEQ ID NO: 507 - protein, 5 aa, Artificial Sequence
  Description of Artificial Sequence: Synthetic peptide
  XENP024532 vhCDR1
SYWMN

SEQ ID NO: 508 - protein, 17 aa, Artificial Sequence
  Description of Artificial Sequence: Synthetic peptide
  XENP024532 vhCDR2
RIDPYDSETHYAQKLQG

SEQ ID NO: 509 - protein, 16 aa, Artificial Sequence
  Description of Artificial Sequence: Synthetic peptide
  XENP024532 vhCDR3
GGYDFDVGTLYWFFDV

SEQ ID NO: 510 - protein, 214 aa, Artificial Sequence; identical to SEQ ID NO: 462
  Description of Artificial Sequence: Synthetic polypeptide
  XENP024532 Chain 3

SEQ ID NO: 511 - protein, 107 aa, Artificial Sequence; identical to SEQ ID NO: 463
  Description of Artificial Sequence: Synthetic polypeptide
  VL of XENP024532

SEQ ID NO: 512 - protein, 11 aa, Artificial Sequence
  Description of Artificial Sequence: Synthetic peptide
  XENP024532 vlCDR1
RASENIYSYLA

SEQ ID NO: 513 - protein, 7 aa, Artificial Sequence
  Description of Artificial Sequence: Synthetic peptide
  XENP024532 vlCDR2
NAKTLAE

SEQ ID NO: 514 - protein, 9 aa, Artificial Sequence
  Description of Artificial Sequence: Synthetic peptide
  XENP024532 vlCDR3
QHHYGTPRT

SEQ ID NO: 515 - protein, 435 aa, Artificial Sequence; identical to SEQ ID NO: 97
  Description of Artificial Sequence: Synthetic polypeptide
  XENP027146 Chain 1

SEQ ID NO: 516 - protein, 65 aa, Artificial Sequence; identical to SEQ ID NO: 4
  Description of Artificial Sequence: Synthetic polypeptide
  XENP027146 Human IL15Ralpha (sushi)

SEQ ID NO: 517 - protein, 114 aa, Artificial Sequence; identical to SEQ ID NO: 99
  Description of Artificial Sequence: Synthetic polypeptide
  XENP027146 Human IL15

SEQ ID NO: 518 - protein, 231 aa, Artificial Sequence; identical to SEQ ID NO: 44
  Description of Artificial Sequence: Synthetic polypeptide
  Fc Chain of XENP027146

SEQ ID NO: 519 - protein, 454 aa, Artificial Sequence; identical to SEQ ID NO: 491
  Description of Artificial Sequence: Synthetic polypeptide
  XENP027146 Chain 2

SEQ ID NO: 520 - protein, 125 aa, Artificial Sequence; identical to SEQ ID NO: 458
  Description of Artificial Sequence: Synthetic polypeptide
  VH of XENP027146

SEQ ID NO: 521 - protein, 5 aa, Artificial Sequence
  Description of Artificial Sequence: Synthetic peptide
  XENP027146 vhCDR1
SYWMN

SEQ ID NO: 522 - protein, 17 aa, Artificial Sequence
  Description of Artificial Sequence: Synthetic peptide
  XENP027146 vhCDR2
RIDPYDSETHYAQKLQG

SEQ ID NO: 523 - protein, 16 aa, Artificial Sequence
  Description of Artificial Sequence: Synthetic peptide
  XENP027146 vhCDR3
GGYDFDVGTLYWFFDV

SEQ ID NO: 524 - protein, 214 aa, Artificial Sequence; identical to SEQ ID NO: 462
  Description of Artificial Sequence: Synthetic polypeptide
  XENP027146 Chain 3

SEQ ID NO: 525 - protein, 107 aa, Artificial Sequence; identical to SEQ ID NO: 463
  Description of Artificial Sequence: Synthetic polypeptide
  VL of XENP027146

SEQ ID NO: 526 - protein, 11 aa, Artificial Sequence
  Description of Artificial Sequence: Synthetic peptide
  XENP027146 vlCDR1
RASENIYSYLA

SEQ ID NO: 527 - protein, 7 aa, Artificial Sequence
  Description of Artificial Sequence: Synthetic peptide
  XENP027146 vlCDR2
NAKTLAE

SEQ ID NO: 528 - protein, 9 aa, Artificial Sequence
  Description of Artificial Sequence: Synthetic peptide
  XENP027146 vlCDR3
QHHYGTPRT

SEQ ID NO: 529 - protein, 435 aa, Artificial Sequence; identical to SEQ ID NO: 377
  Description of Artificial Sequence: Synthetic polypeptide
  XENP024533 Chain 1

SEQ ID NO: 530 - protein, 65 aa, Artificial Sequence; identical to SEQ ID NO: 4
  Description of Artificial Sequence: Synthetic polypeptide
  XENP024533 Human IL15Ralpha (sushi)

SEQ ID NO: 531 - protein, 114 aa, Artificial Sequence; identical to SEQ ID NO: 276
  Description of Artificial Sequence: Synthetic polypeptide
  XENP024533 Human IL15

SEQ ID NO: 532 - protein, 231 aa, Artificial Sequence; identical to SEQ ID NO: 44
  Description of Artificial Sequence: Synthetic polypeptide
  Fc Chain of XENP024533

SEQ ID NO: 533 - protein, 444 aa, Artificial Sequence
  Description of Artificial Sequence: Synthetic polypeptide
  XENP024533 Chain 2
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 534 - protein, 115 aa, Artificial Sequence; identical to SEQ ID NO: 478
  Description of Artificial Sequence: Synthetic polypeptide
  VH of XENP024533

SEQ ID NO: 535 - protein, 5 aa, Artificial Sequence
  Description of Artificial Sequence: Synthetic peptide
  XENP024533 vhCDR1
SYYWS

SEQ ID NO: 536 - protein, 16 aa, Artificial Sequence
  Description of Artificial Sequence: Synthetic peptide
  XENP024533 vhCDR2
HISYSGSANYNPSLKS

SEQ ID NO: 537 - protein, 7 aa, Artificial Sequence
  Description of Artificial Sequence: Synthetic peptide
  XENP024533 vhCDR3
WDDAFNI

SEQ ID NO: 538 - protein, 215 aa, Artificial Sequence; identical to SEQ ID NO: 482
  Description of Artificial Sequence: Synthetic polypeptide
  XENP024533 Chain 3

SEQ ID NO: 539 - protein, 108 aa, Artificial Sequence; identical to SEQ ID NO: 483
  Description of Artificial Sequence: Synthetic polypeptide
  VL of XENP024533

SEQ ID NO: 540 - protein, 12 aa, Artificial Sequence
  Description of Artificial Sequence: Synthetic peptide
  XENP024533 vlCDR1
RASQSVSSSYLA

SEQ ID NO: 541 - protein, 7 aa, Artificial Sequence
  Description of Artificial Sequence: Synthetic peptide
  XENP024533 vlCDR2
GASSRAT

SEQ ID NO: 542 - protein, 9 aa, Artificial Sequence
  Description of Artificial Sequence: Synthetic peptide
  XENP024533 vlCDR3
QQYGSSPWT

SEQ ID NO: 543 - protein, 435 aa, Artificial Sequence; identical to SEQ ID NO: 382
  Description of Artificial Sequence: Synthetic polypeptide
  XENP024534 Chain 1

SEQ ID NO: 544 - protein, 65 aa, Artificial Sequence; identical to SEQ ID NO: 4
  Description of Artificial Sequence: Synthetic polypeptide
  XENP024534 Human IL15Ralpha (sushi)

SEQ ID NO: 545 - protein, 114 aa, Artificial Sequence; identical to SEQ ID NO: 277
  Description of Artificial Sequence: Synthetic polypeptide
  XENP024534 Human IL15

SEQ ID NO: 546 - protein, 231 aa, Artificial Sequence; identical to SEQ ID NO: 44
  Description of Artificial Sequence: Synthetic polypeptide
  Fc Chain of XENP024534

SEQ ID NO: 547 - protein, 444 aa, Artificial Sequence; identical to SEQ ID NO: 533
  Description of Artificial Sequence: Synthetic polypeptide
  XENP024534 Chain 2

SEQ ID NO: 548 - protein, 115 aa, Artificial Sequence; identical to SEQ ID NO: 478
  Description of Artificial Sequence: Synthetic polypeptide
  VH of XENP024534

SEQ ID NO: 549 - protein, 5 aa, Artificial Sequence
  Description of Artificial Sequence: Synthetic peptide
  XENP024534 vhCDR1
SYYWS

SEQ ID NO: 550 - protein, 16 aa, Artificial Sequence
  Description of Artificial Sequence: Synthetic peptide
  XENP024534 vhCDR2
HISYSGSANYNPSLKS

SEQ ID NO: 551 - protein, 7 aa, Artificial Sequence
  Description of Artificial Sequence: Synthetic peptide
  XENP024534 vhCDR3
WDDAFNI

SEQ ID NO: 552 - protein, 215 aa, Artificial Sequence; identical to SEQ ID NO: 482
  Description of Artificial Sequence: Synthetic polypeptide
  XENP024534 Chain 3

SEQ ID NO: 553 - protein, 108 aa, Artificial Sequence; identical to SEQ ID NO: 483
  Description of Artificial Sequence: Synthetic polypeptide
  VL of XENP024534

SEQ ID NO: 554 - protein, 12 aa, Artificial Sequence
  Description of Artificial Sequence: Synthetic peptide
  XENP024534 vlCDR1
RASQSVSSSYLA

SEQ ID NO: 555 - protein, 7 aa, Artificial Sequence
  Description of Artificial Sequence: Synthetic peptide
  XENP024534 vlCDR2
GASSRAT

SEQ ID NO: 556 - protein, 9 aa, Artificial Sequence
  Description of Artificial Sequence: Synthetic peptide
  XENP024534 vlCDR3
QQYGSSPWT

SEQ ID NO: 557 - protein, 435 aa, Artificial Sequence; identical to SEQ ID NO: 97
  Description of Artificial Sequence: Synthetic polypeptide
  XENP027145 Chain 1

SEQ ID NO: 558 - protein, 65 aa, Artificial Sequence; identical to SEQ ID NO: 4
  Description of Artificial Sequence: Synthetic polypeptide
  XENP027145 Human IL15Ralpha (sushi)

SEQ ID NO: 559 - protein, 114 aa, Artificial Sequence; identical to SEQ ID NO: 99
  Description of Artificial Sequence: Synthetic polypeptide
  XENP027145 Human IL15

SEQ ID NO: 560 - protein, 231 aa, Artificial Sequence; identical to SEQ ID NO: 44
  Description of Artificial Sequence: Synthetic polypeptide
  Fc Chain of XENP027145

SEQ ID NO: 561 - protein, 444 aa, Artificial Sequence; identical to SEQ ID NO: 533
  Description of Artificial Sequence: Synthetic polypeptide
  XENP027145 Chain 2

SEQ ID NO: 562 - protein, 115 aa, Artificial Sequence; identical to SEQ ID NO: 478
  Description of Artificial Sequence: Synthetic polypeptide
  VH of XENP027145

SEQ ID NO: 563 - protein, 5 aa, Artificial Sequence
  Description of Artificial Sequence: Synthetic peptide
  XENP027145 vhCDR1
SYYWS

SEQ ID NO: 564 - protein, 16 aa, Artificial Sequence
  Description of Artificial Sequence: Synthetic peptide
  XENP027145 vhCDR2
HISYSGSANYNPSLKS

SEQ ID NO: 565 - protein, 7 aa, Artificial Sequence
  Description of Artificial Sequence: Synthetic peptide
  XENP027145 vhCDR3
WDDAFNI

SEQ ID NO: 566 - protein, 215 aa, Artificial Sequence; identical to SEQ ID NO: 482
  Description of Artificial Sequence: Synthetic polypeptide
  XENP027145 Chain 3

SEQ ID NO: 567 - protein, 108 aa, Artificial Sequence; identical to SEQ ID NO: 483
  Description of Artificial Sequence: Synthetic polypeptide
  VL of XENP027145

SEQ ID NO: 568 - protein, 12 aa, Artificial Sequence
  Description of Artificial Sequence: Synthetic peptide
  XENP027145 vlCDR1
RASQSVSSSYLA

SEQ ID NO: 569 - protein, 7 aa, Artificial Sequence
  Description of Artificial Sequence: Synthetic peptide
  XENP027145 vlCDR2
GASSRAT

SEQ ID NO: 570 - protein, 9 aa, Artificial Sequence
  Description of Artificial Sequence: Synthetic peptide
  XENP027145 vlCDR3
QQYGSSPWT

SEQ ID NO: 571 - protein, 447 aa, Artificial Sequence
  Description of Artificial Sequence: Synthetic polypeptide
  XENP015076 Chain 1
QIQLVQSGPELRKPGETVRISCKASGYSFTNFGMIWVKQAPGKGLKWLGWINTYTGEPTYADDLKGRFAFSLETSANTAYLKINNFKNEDMATYFCARKDYAGFFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 572 - protein, 118 aa, Artificial Sequence
  Description of Artificial Sequence: Synthetic polypeptide
  VH of XENP015076
QIQLVQSGPELRKPGETVRISCKASGYSFTNFGMIWVKQAPGKGLKWLGWINTYTGEPTYADDLKGRFAFSLETSANTAYLKINNFKNEDMATYFCARKDYAGFFDYWGQGTTLTVSS

SEQ ID NO: 573 - protein, 5 aa, Artificial Sequence
  Description of Artificial Sequence: Synthetic peptide
  XENP015076 vhCDR1
NFGMI

SEQ ID NO: 574 - protein, 17 aa, Artificial Sequence
  Description of Artificial Sequence: Synthetic peptide
  XENP015076 vhCDR2
WINTYTGEPTYADDLKG

SEQ ID NO: 575 - protein, 9 aa, Artificial Sequence
  Description of Artificial Sequence: Synthetic peptide
  XENP015076 vhCDR3
KDYAGFFDY

SEQ ID NO: 576 - protein, 214 aa, Artificial Sequence
  Description of Artificial Sequence: Synthetic polypeptide
  XENP015076 Chain 2
DILMTQSPSSMSVSLGDTVSITCHASQDIGSNMGWLQQKPGKSFKALIYHGTNLEYGVPSRFSGSGSGADYSLSISSLESEDFADYYCVQFAQFPYTFGGGTSLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 577 - protein, 107 aa, Artificial Sequence
  Description of Artificial Sequence: Synthetic polypeptide
  VL of XENP015076
DILMTQSPSSMSVSLGDTVSITCHASQDIGSNMGWLQQKPGKSFKALIYHGTNLEYGVPSRFSGSGSGADYSLSISSLESEDFADYYCVQFAQFPYTFGGGTSLEIK

SEQ ID NO: 578 - protein, 11 aa, Artificial Sequence
  Description of Artificial Sequence: Synthetic peptide
  XENP015076 vlCDR1
HASQDIGSNMG

SEQ ID NO: 579 - protein, 7 aa, Artificial Sequence
  Description of Artificial Sequence: Synthetic peptide
  XENP015076 vlCDR2
HGTNLEY

SEQ ID NO: 580 - protein, 9 aa, Artificial Sequence
  Description of Artificial Sequence: Synthetic peptide
  XENP015076 vlCDR3
VQFAQFPYT

SEQ ID NO: 581 - protein, 447 aa, Artificial Sequence
  Description of Artificial Sequence: Synthetic polypeptide
  XENP015251 Chain 1
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 582 - protein, 118 aa, Artificial Sequence
  Description of Artificial Sequence: Synthetic polypeptide
  VH of XENP015251
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSS

SEQ ID NO: 583 - protein, 5 aa, Artificial Sequence
  Description of Artificial Sequence: Synthetic peptide
  XENP015251 vhCDR1
NFGMI

SEQ ID NO: 584 - protein, 17 aa, Artificial Sequence
  Description of Artificial Sequence: Synthetic peptide
  XENP015251 vhCDR2
WINTYTGEPTYADGFTG

SEQ ID NO: 585 - protein, 9 aa, Artificial Sequence
  Description of Artificial Sequence: Synthetic peptide
  XENP015251 vhCDR3
KDYAGFFDY

SEQ ID NO: 586 - protein, 214 aa, Artificial Sequence
  Description of Artificial Sequence: Synthetic polypeptide
  XENP015251 Chain 2
DILMTQSPSSLSASVGDRVTITCQASQDIGSNMGWLQQKPGKSFKALIYHGTNLEYGVPSRFSGSGSGADYTLTISSLQPEDFATYYCVQFAQFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 587 - protein, 107 aa, Artificial Sequence
  Description of Artificial Sequence: Synthetic polypeptide
  VL of XENP015251
DILMTQSPSSLSASVGDRVTITCQASQDIGSNMGWLQQKPGKSFKALIYHGTNLEYGVPSRFSGSGSGADYTLTISSLQPEDFATYYCVQFAQFPYTFGGGTKVEIK

SEQ ID NO: 588 - protein, 11 aa, Artificial Sequence
  Description of Artificial Sequence: Synthetic peptide
  XENP015251 vlCDR1
QASQDIGSNMG

SEQ ID NO: 589 - protein, 7 aa, Artificial Sequence
  Description of Artificial Sequence: Synthetic peptide
  XENP015251 vlCDR2
HGTNLEY

SEQ ID NO: 590 - protein, 9 aa, Artificial Sequence
  Description of Artificial Sequence: Synthetic peptide
  XENP015251 vlCDR3
VQFAQFPYT

SEQ ID NO: 591 - protein, 223 aa, Artificial Sequence
  Description of Artificial Sequence: Synthetic polypeptide
  XENP023647 Chain 1
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 592 - protein, 118 aa, Artificial Sequence; identical to SEQ ID NO: 582
  Description of Artificial Sequence: Synthetic polypeptide
  VH of XENP023647

SEQ ID NO: 593 - protein, 5 aa, Artificial Sequence
  Description of Artificial Sequence: Synthetic peptide
  XENP023647 vhCDR1
NFGMI

SEQ ID NO: 594 - protein, 17 aa, Artificial Sequence
  Description of Artificial Sequence: Synthetic peptide
  XENP023647 vhCDR2
WINTYTGEPTYADGFTG

SEQ ID NO: 595 - protein, 9 aa, Artificial Sequence
  Description of Artificial Sequence: Synthetic peptide
  XENP023647 vhCDR3
KDYAGFFDY

SEQ ID NO: 596 - protein, 214 aa, Artificial Sequence; identical to SEQ ID NO: 586
  Description of Artificial Sequence: Synthetic polypeptide
  XENP023647 Chain 2

SEQ ID NO: 597 - protein, 107 aa, Artificial Sequence; identical to SEQ ID NO: 587
  Description of Artificial Sequence: Synthetic polypeptide
  VL of XENP023647

SEQ ID NO: 598 - protein, 11 aa, Artificial Sequence
  Description of Artificial Sequence: Synthetic peptide
  XENP023647 vlCDR1
QASQDIGSNMG

SEQ ID NO: 599 - protein, 7 aa, Artificial Sequence
  Description of Artificial Sequence: Synthetic peptide
  XENP023647 vlCDR2
HGTNLEY

SEQ ID NO: 600 - protein, 9 aa, Artificial Sequence
  Description of Artificial Sequence: Synthetic peptide
  XENP023647 vlCDR3
VQFAQFPYT

SEQ ID NO: 601 - protein, 447 aa, Artificial Sequence
  Description of Artificial Sequence: Synthetic polypeptide
  XENP024317 Chain 1
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 602 - protein, 118 aa, Artificial Sequence; identical to SEQ ID NO: 582
  Description of Artificial Sequence: Synthetic polypeptide
  VH of XENP024317

SEQ ID NO: 603 - protein, 5 aa, Artificial Sequence
  Description of Artificial Sequence: Synthetic peptide
  XENP024317 vhCDR1
NFGMI

SEQ ID NO: 604 - protein, 17 aa, Artificial Sequence
  Description of Artificial Sequence: Synthetic peptide
  XENP024317 vhCDR2
WINTYTGEPTYADGFTG

SEQ ID NO: 605 - protein, 9 aa, Artificial Sequence
  Description of Artificial Sequence: Synthetic peptide
  XENP024317 vhCDR3
KDYAGFFDY

SEQ ID NO: 606 - protein, 214 aa, Artificial Sequence
  Description of Artificial Sequence: Synthetic polypeptide
  XENP024317 Chain 2
DILMTQSPSSLSASVGDRVTITCQASQDIGSDMGWLQQKPGKSFKALIYHGTNLEYGVPSRFSGSGSGADYTLTISSLQPEDFATYYCVQFAQFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 607 - protein, 107 aa, Artificial Sequence
  Description of Artificial Sequence: Synthetic polypeptide
  VL of XENP024317
DILMTQSPSSLSASVGDRVTITCQASQDIGSDMGWLQQKPGKSFKALIYHGTNLEYGVPSRFSGSGSGADYTLTISSLQPEDFATYYCVQFAQFPYTFGGGTKVEIK

SEQ ID NO: 608 - protein, 11 aa, Artificial Sequence
  Description of Artificial Sequence: Synthetic peptide
  XENP024317 vlCDR1
QASQDIGSDMG

SEQ ID NO: 609 - protein, 7 aa, Artificial Sequence
  Description of Artificial Sequence: Synthetic peptide
  XENP024317 vlCDR2
HGTNLEY

SEQ ID NO: 610 - protein, 9 aa, Artificial Sequence
  Description of Artificial Sequence: Synthetic peptide
  XENP024317 vlCDR3
VQFAQFPYT

SEQ ID NO: 611 - protein, 231 aa, Artificial Sequence; identical to SEQ ID NO: 68
  Description of Artificial Sequence: Synthetic polypeptide
  XENP024317 Chain 3

SEQ ID NO: 612 - protein, 435 aa, Artificial Sequence; identical to SEQ ID NO: 137
  Description of Artificial Sequence: Synthetic polypeptide
  XENP024114 Chain 1

SEQ ID NO: 613 - protein, 65 aa, Artificial Sequence; identical to SEQ ID NO: 4
  Description of Artificial Sequence: Synthetic polypeptide
  XENP024114 Human IL15Ralpha (sushi)

SEQ ID NO: 614 - protein, 114 aa, Artificial Sequence; identical to SEQ ID NO: 2
  Description of Artificial Sequence: Synthetic polypeptide
  XENP024114 Human IL15

SEQ ID NO: 615 - protein, 231 aa, Artificial Sequence; identical to SEQ ID NO: 44
  Description of Artificial Sequence: Synthetic polypeptide
  Fc Chain of XENP024114

SEQ ID NO: 616 - protein, 447 aa, Artificial Sequence
  Description of Artificial Sequence: Synthetic polypeptide
  XENP024114 Chain 2
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 617 - protein, 118 aa, Artificial Sequence; identical to SEQ ID NO: 582
  Description of Artificial Sequence: Synthetic polypeptide
  VH of XENP024114

SEQ ID NO: 618 - protein, 5 aa, Artificial Sequence
  Description of Artificial Sequence: Synthetic peptide
  XENP024114 vhCDR1
NFGMI

SEQ ID NO: 619 - protein, 17 aa, Artificial Sequence
  Description of Artificial Sequence: Synthetic peptide
  XENP024114 vhCDR2
WINTYTGEPTYADGFTG

SEQ ID NO: 620 - protein, 9 aa, Artificial Sequence
  Description of Artificial Sequence: Synthetic peptide
  XENP024114 vhCDR3
KDYAGFFDY

SEQ ID NO: 621 - protein, 214 aa, Artificial Sequence; identical to SEQ ID NO: 586
  Description of Artificial Sequence: Synthetic polypeptide
  XENP024114 Chain 3

SEQ ID NO: 622 - protein, 107 aa, Artificial Sequence; identical to SEQ ID NO: 587
  Description of Artificial Sequence: Synthetic polypeptide
  VL of XENP024114

SEQ ID NO: 623 - protein, 11 aa, Artificial Sequence
  Description of Artificial Sequence: Synthetic peptide
  XENP024114 vlCDR1
QASQDIGSNMG

SEQ ID NO: 624 - protein, 7 aa, Artificial Sequence
  Description of Artificial Sequence: Synthetic peptide
  XENP024114 vlCDR2
HGTNLEY

SEQ ID NO: 625 - protein, 9 aa, Artificial Sequence
  Description of Artificial Sequence: Synthetic peptide
  XENP024114 vlCDR3
VQFAQFPYT

SEQ ID NO: 626 - protein, 435 aa, Artificial Sequence; identical to SEQ ID NO: 142
  Description of Artificial Sequence: Synthetic polypeptide
  XENP024115 Chain 1

SEQ ID NO: 627 - protein, 65 aa, Artificial Sequence; identical to SEQ ID NO: 4
  Description of Artificial Sequence: Synthetic polypeptide
  XENP024115 Human IL15Ralpha (sushi)

SEQ ID NO: 628 - protein, 114 aa, Artificial Sequence; identical to SEQ ID NO: 144
  Description of Artificial Sequence: Synthetic polypeptide
  XENP024115 Human IL15

SEQ ID NO: 629 - protein, 231 aa, Artificial Sequence; identical to SEQ ID NO: 44
  Description of Artificial Sequence: Synthetic polypeptide
  Fc Chain of XENP024115

SEQ ID NO: 630 - protein, 447 aa, Artificial Sequence; identical to SEQ ID NO: 616
  Description of Artificial Sequence: Synthetic polypeptide
  XENP024115 Chain 2

SEQ ID NO: 631 - protein, 118 aa, Artificial Sequence; identical to SEQ ID NO: 582
  Description of Artificial Sequence: Synthetic polypeptide
  VH of XENP024115

SEQ ID NO: 632 - protein, 5 aa, Artificial Sequence
  Description of Artificial Sequence: Synthetic peptide
  XENP024115 vhCDR1
NFGMI

SEQ ID NO: 633 - protein, 17 aa, Artificial Sequence
  Description of Artificial Sequence: Synthetic peptide
  XENP024115 vhCDR2
WINTYTGEPTYADGFTG

SEQ ID NO: 634 - protein, 9 aa, Artificial Sequence
  Description of Artificial Sequence: Synthetic peptide
  XENP024115 vhCDR3
KDYAGFFDY

SEQ ID NO: 635 - protein, 214 aa, Artificial Sequence; identical to SEQ ID NO: 586
  Description of Artificial Sequence: Synthetic polypeptide
  XENP024115 Chain 3

SEQ ID NO: 636 - protein, 107 aa, Artificial Sequence; identical to SEQ ID NO: 587
  Description of Artificial Sequence: Synthetic polypeptide
  VL of XENP024115

SEQ ID NO: 637 - protein, 11 aa, Artificial Sequence
  Description of Artificial Sequence: Synthetic peptide
  XENP024115 vlCDR1
QASQDIGSNMG

SEQ ID NO: 638 - protein, 7 aa, Artificial Sequence
  Description of Artificial Sequence: Synthetic peptide
  XENP024115 vlCDR2
HGTNLEY

SEQ ID NO: 639 - protein, 9 aa, Artificial Sequence
  Description of Artificial Sequence: Synthetic peptide
  XENP024115 vlCDR3
VQFAQFPYT

SEQ ID NO: 640 - protein, 435 aa, Artificial Sequence; identical to SEQ ID NO: 377
  Description of Artificial Sequence: Synthetic polypeptide
  XENP024116 Chain 1

SEQ ID NO: 641 - protein, 65 aa, Artificial Sequence; identical to SEQ ID NO: 4
  Description of Artificial Sequence: Synthetic polypeptide
  XENP024116 Human IL15Ralpha (sushi)

SEQ ID NO: 642 - protein, 114 aa, Artificial Sequence; identical to SEQ ID NO: 276
  Description of Artificial Sequence: Synthetic polypeptide
  XENP024116 Human IL15

SEQ ID NO: 643 - protein, 231 aa, Artificial Sequence; identical to SEQ ID NO: 44
  Description of Artificial Sequence: Synthetic polypeptide
  Fc Chain of XENP024116

SEQ ID NO: 644 - protein, 447 aa, Artificial Sequence; identical to SEQ ID NO: 616
  Description of Artificial Sequence: Synthetic polypeptide
  XENP024116 Chain 2

SEQ ID NO: 645 - protein, 118 aa, Artificial Sequence; identical to SEQ ID NO: 582
  Description of Artificial Sequence: Synthetic polypeptide
  VH of XENP024116

SEQ ID NO: 646 - protein, 5 aa, Artificial Sequence
  Description of Artificial Sequence: Synthetic peptide
  XENP024116 vhCDR1
NFGMI

SEQ ID NO: 647 - protein, 17 aa, Artificial Sequence
  Description of Artificial Sequence: Synthetic peptide
  XENP024116 vhCDR2
WINTYTGEPTYADGFTG

SEQ ID NO: 648 - protein, 9 aa, Artificial Sequence
  Description of Artificial Sequence: Synthetic peptide
  XENP024116 vhCDR3
KDYAGFFDY

SEQ ID NO: 649 - protein, 214 aa, Artificial Sequence; identical to SEQ ID NO: 586
  Description of Artificial Sequence: Synthetic polypeptide
  XENP024116 Chain 3

SEQ ID NO: 650 - protein, 107 aa, Artificial Sequence; identical to SEQ ID NO: 587
  Description of Artificial Sequence: Synthetic polypeptide
  VL of XENP024116

SEQ ID NO: 651 - protein, 11 aa, Artificial Sequence
  Description of Artificial Sequence: Synthetic peptide
  XENP024116 vlCDR1
QASQDIGSNMG

SEQ ID NO: 652 - protein, 7 aa, Artificial Sequence
  Description of Artificial Sequence: Synthetic peptide
  XENP024116 vlCDR2
HGTNLEY

SEQ ID NO: 653 - protein, 9 aa, Artificial Sequence
  Description of Artificial Sequence: Synthetic peptide
  XENP024116 vlCDR3
VQFAQFPYT

SEQ ID NO: 654 - protein, 522 aa, Artificial Sequence
  Description of Artificial Sequence: Synthetic polypeptide
  XENP024543 Chain 1
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 655 - protein, 118 aa, Artificial Sequence; identical to SEQ ID NO: 582
  Description of Artificial Sequence: Synthetic polypeptide
  VH of XENP024543

SEQ ID NO: 656 - protein, 5 aa, Artificial Sequence
  Description of Artificial Sequence: Synthetic peptide
  XENP024543 vhCDR1
NFGMI

SEQ ID NO: 657 - protein, 17 aa, Artificial Sequence
  Description of Artificial Sequence: Synthetic peptide
  XENP024543 vhCDR2
WINTYTGEPTYADGFTG

SEQ ID NO: 658 - protein, 9 aa, Artificial Sequence
  Description of Artificial Sequence: Synthetic peptide
  XENP024543 vhCDR3
KDYAGFFDY

SEQ ID NO: 659 - protein, 65 aa, Artificial Sequence; identical to SEQ ID NO: 4
  Description of Artificial Sequence: Synthetic polypeptide
  XENP024543 IL15Ralpha(sushi)

SEQ ID NO: 660 - protein, 447 aa, Artificial Sequence; identical to SEQ ID NO: 616
  Description of Artificial Sequence: Synthetic polypeptide
  XENP024543 Chain 2

SEQ ID NO: 661 - protein, 118 aa, Artificial Sequence; identical to SEQ ID NO: 582
  Description of Artificial Sequence: Synthetic polypeptide
  VH of XENP024543

SEQ ID NO: 662 - protein, 5 aa, Artificial Sequence
  Description of Artificial Sequence: Synthetic peptide
  XENP024543 vhCDR1
NFGMI

SEQ ID NO: 663 - protein, 17 aa, Artificial Sequence
  Description of Artificial Sequence: Synthetic peptide
  XENP024543 vhCDR2
WINTYTGEPTYADGFTG

SEQ ID NO: 664 - protein, 9 aa, Artificial Sequence
  Description of Artificial Sequence: Synthetic peptide
  XENP024543 vhCDR3
KDYAGFFDY

SEQ ID NO: 665 - protein, 214 aa, Artificial Sequence; identical to SEQ ID NO: 586
  Description of Artificial Sequence: Synthetic polypeptide
  XENP024543 Chain 3

SEQ ID NO: 666 - protein, 107 aa, Artificial Sequence; identical to SEQ ID NO: 587
  Description of Artificial Sequence: Synthetic polypeptide
  VL of XENP024543

SEQ ID NO: 667 - protein, 11 aa, Artificial Sequence
  Description of Artificial Sequence: Synthetic peptide
  XENP024543 vlCDR1
QASQDIGSNMG

SEQ ID NO: 668 - protein, 7 aa, Artificial Sequence
  Description of Artificial Sequence: Synthetic peptide
  XENP024543 vlCDR2
HGTNLEY

SEQ ID NO: 669 - protein, 9 aa, Artificial Sequence
  Description of Artificial Sequence: Synthetic peptide
  XENP024543 vlCDR3
VQFAQFPYT

SEQ ID NO: 670 - protein, 114 aa, Artificial Sequence; identical to SEQ ID NO: 276
  Description of Artificial Sequence: Synthetic polypeptide
  XENP024543 Chain 4

SEQ ID NO: 671 - protein, 660 aa, Artificial Sequence
  Description of Artificial Sequence: Synthetic polypeptide
  XENP024546 Chain 1
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGGGGGSGGGGSITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 672 - protein, 118 aa, Artificial Sequence; identical to SEQ ID NO: 582
  Description of Artificial Sequence: Synthetic polypeptide
  VH of XENP024546

SEQ ID NO: 673 - protein, 5 aa, Artificial Sequence
  Description of Artificial Sequence: Synthetic peptide
  XENP024546 vhCDR1
NFGMI

SEQ ID NO: 674 - protein, 17 aa, Artificial Sequence
  Description of Artificial Sequence: Synthetic peptide
  XENP024546 vhCDR2
WINTYTGEPTYADGFTG

SEQ ID NO: 675 - protein, 9 aa, Artificial Sequence
  Description of Artificial Sequence: Synthetic peptide
  XENP024546 vhCDR3
KDYAGFFDY

SEQ ID NO: 676 - protein, 65 aa, Artificial Sequence; identical to SEQ ID NO: 4
  Description of Artificial Sequence: Synthetic polypeptide
  XENP024546 IL15Ralpha(sushi)

SEQ ID NO: 677 - protein, 114 aa, Artificial Sequence; identical to SEQ ID NO: 2
  Description of Artificial Sequence: Synthetic polypeptide
  XENP024546 IL15

SEQ ID NO: 678 - protein, 447 aa, Artificial Sequence; identical to SEQ ID NO: 616
  Description of Artificial Sequence: Synthetic polypeptide
  XENP024546 Chain 2

SEQ ID NO: 679 - protein, 118 aa, Artificial Sequence; identical to SEQ ID NO: 582
  Description of Artificial Sequence: Synthetic polypeptide
  VH of XENP024546

SEQ ID NO: 680 - protein, 5 aa, Artificial Sequence
  Description of Artificial Sequence: Synthetic peptide
  XENP024546 vhCDR1
NFGMI

SEQ ID NO: 681 - protein, 17 aa, Artificial Sequence
  Description of Artificial Sequence: Synthetic peptide
  XENP024546 vhCDR2
WINTYTGEPTYADGFTG

SEQ ID NO: 682 - protein, 9 aa, Artificial Sequence
  Description of Artificial Sequence: Synthetic peptide
  XENP024546 vhCDR3
KDYAGFFDY

SEQ ID NO: 683 - protein, 214 aa, Artificial Sequence; identical to SEQ ID NO: 586
  Description of Artificial Sequence: Synthetic polypeptide
  XENP024546 Chain 3

SEQ ID NO: 684 - protein, 107 aa, Artificial Sequence; identical to SEQ ID NO: 587
  Description of Artificial Sequence: Synthetic polypeptide
  VL of XENP024546

SEQ ID NO: 685 - protein, 11 aa, Artificial Sequence
  Description of Artificial Sequence: Synthetic peptide
  XENP024546 vlCDR1
QASQDIGSNMG

SEQ ID NO: 686 - protein, 7 aa, Artificial Sequence
  Description of Artificial Sequence: Synthetic peptide
  XENP024546 vlCDR2
HGTNLEY

SEQ ID NO: 687 - protein, 9 aa, Artificial Sequence
  Description of Artificial Sequence: Synthetic peptide
  XENP024546 vlCDR3
VQFAQFPYT

SEQ ID NO: 688 - protein, 581 aa, Artificial Sequence
  Description of Artificial Sequence: Synthetic polypeptide
  XENP024547 Chain 1
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 689 - protein, 118 aa, Artificial Sequence; identical to SEQ ID NO: 582
  Description of Artificial Sequence: Synthetic polypeptide
  VH of XENP024547

SEQ ID NO: 690 - protein, 5 aa, Artificial Sequence
  Description of Artificial Sequence: Synthetic peptide
  XENP024547 vhCDR1
NFGMI

SEQ ID NO: 691 - protein, 17 aa, Artificial Sequence
  Description of Artificial Sequence: Synthetic peptide
  XENP024547 vhCDR2
WINTYTGEPTYADGFTG

SEQ ID NO: 692 - protein, 9 aa, Artificial Sequence
  Description of Artificial Sequence: Synthetic peptide
  XENP024547 vhCDR3
KDYAGFFDY

SEQ ID NO: 693 - protein, 114 aa, Artificial Sequence; identical to SEQ ID NO: 99
  Description of Artificial Sequence: Synthetic polypeptide
  XENP024547 IL15

SEQ ID NO: 694 - protein, 231 aa, Artificial Sequence; identical to SEQ ID NO: 44
  Description of Artificial Sequence: Synthetic polypeptide
  Fc Chain of XENP024547

SEQ ID NO: 695 - protein, 532 aa, Artificial Sequence
  Description of Artificial Sequence: Synthetic polypeptide
  XENP024547 Chain 2
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 696 - protein, 118 aa, Artificial Sequence; identical to SEQ ID NO: 582
  Description of Artificial Sequence: Synthetic polypeptide
  VH of XENP024547

SEQ ID NO: 697 - protein, 5 aa, Artificial Sequence
  Description of Artificial Sequence: Synthetic peptide
  XENP024547 vhCDR1
NFGMI

SEQ ID NO: 698 - protein, 17 aa, Artificial Sequence
  Description of Artificial Sequence: Synthetic peptide
  XENP024547 vhCDR2
WINTYTGEPTYADGFTG

SEQ ID NO: 699 - protein, 9 aa, Artificial Sequence
  Description of Artificial Sequence: Synthetic peptide
  XENP024547 vhCDR3
KDYAGFFDY

SEQ ID NO: 700 - protein, 65 aa, Artificial Sequence; identical to SEQ ID NO: 4
  Description of Artificial Sequence: Synthetic polypeptide
  XENP024547 IL15Ralpha(sushi)

SEQ ID NO: 701 - protein, 231 aa, Artificial Sequence; identical to SEQ ID NO: 43
  Description of Artificial Sequence: Synthetic polypeptide
  Fc Chain of XENP024547

SEQ ID NO: 702 - protein, 214 aa, Artificial Sequence; identical to SEQ ID NO: 586
  Description of Artificial Sequence: Synthetic polypeptide
  XENP024547 Chain 3

SEQ ID NO: 703 - protein, 107 aa, Artificial Sequence; identical to SEQ ID NO: 587
  Description of Artificial Sequence: Synthetic polypeptide
  VL of XENP024547

SEQ ID NO: 704 - protein, 11 aa, Artificial Sequence
  Description of Artificial Sequence: Synthetic peptide
  XENP024547 vlCDR1
QASQDIGSNMG

SEQ ID NO: 705 - protein, 7 aa, Artificial Sequence
  Description of Artificial Sequence: Synthetic peptide
  XENP024547 vlCDR2
HGTNLEY

SEQ ID NO: 706 - protein, 9 aa, Artificial Sequence
  Description of Artificial Sequence: Synthetic peptide
  XENP024547 vlCDR3
VQFAQFPYT

SEQ ID NO: 707 - protein, 666 aa, Artificial Sequence
  Description of Artificial Sequence: Synthetic polypeptide
  XENP024548 Chain 1
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 708 - protein, 118 aa, Artificial Sequence; identical to SEQ ID NO: 582
  Description of Artificial Sequence: Synthetic polypeptide
  VH of XENP024548

SEQ ID NO: 709 - protein, 5 aa, Artificial Sequence
  Description of Artificial Sequence: Synthetic peptide
  XENP024548 vhCDR1
NFGMI

SEQ ID NO: 710 - protein, 17 aa, Artificial Sequence
  Description of Artificial Sequence: Synthetic peptide
  XENP024548 vhCDR2
WINTYTGEPTYADGFTG

SEQ ID NO: 711 - protein, 9 aa, Artificial Sequence
  Description of Artificial Sequence: Synthetic peptide
  XENP024548 vhCDR3
KDYAGFFDY

SEQ ID NO: 712 - protein, 65 aa, Artificial Sequence; identical to SEQ ID NO: 4
  Description of Artificial Sequence: Synthetic polypeptide
  XENP024548 IL15Ralpha(sushi)

SEQ ID NO: 713 - protein, 114 aa, Artificial Sequence; identical to SEQ ID NO: 2
  Description of Artificial Sequence: Synthetic polypeptide
  XENP024548 IL15

SEQ ID NO: 714 - protein, 231 aa, Artificial Sequence; identical to SEQ ID NO: 44
  Description of Artificial Sequence: Synthetic polypeptide
  Fc Chain of XENP024548

SEQ ID NO: 715 - protein, 447 aa, Artificial Sequence; identical to SEQ ID NO: 616
  Description of Artificial Sequence: Synthetic polypeptide
  XENP024548 Chain 2

SEQ ID NO: 716 - protein, 118 aa, Artificial Sequence; identical to SEQ ID NO: 582
  Description of Artificial Sequence: Synthetic polypeptide
  VH of XENP024548

SEQ ID NO: 717 - protein, 5 aa, Artificial Sequence
  Description of Artificial Sequence: Synthetic peptide
  XENP024548 vhCDR1
NFGMI

SEQ ID NO: 718 - protein, 17 aa, Artificial Sequence
  Description of Artificial Sequence: Synthetic peptide
  XENP024548 vhCDR2
WINTYTGEPTYADGFTG

SEQ ID NO: 719 - protein, 9 aa, Artificial Sequence
  Description of Artificial Sequence: Synthetic peptide
  XENP024548 vhCDR3
KDYAGFFDY

SEQ ID NO: 720 - protein, 214 aa, Artificial Sequence; identical to SEQ ID NO: 586
  Description of Artificial Sequence: Synthetic polypeptide
  XENP024548 Chain 3

SEQ ID NO: 721 - protein, 107 aa, Artificial Sequence; identical to SEQ ID NO: 587
  Description of Artificial Sequence: Synthetic polypeptide
  VL of XENP024548

SEQ ID NO: 722 - protein, 11 aa, Artificial Sequence
  Description of Artificial Sequence: Synthetic peptide
  XENP024548 vlCDR1
QASQDIGSNMG

SEQ ID NO: 723 - protein, 7 aa, Artificial Sequence
  Description of Artificial Sequence: Synthetic peptide
  XENP024548 vlCDR2
HGTNLEY

SEQ ID NO: 724 - protein, 9 aa, Artificial Sequence
  Description of Artificial Sequence: Synthetic peptide
  XENP024548 vlCDR3
VQFAQFPYT

SEQ ID NO: 725 - protein, 450 aa, Artificial Sequence
  Description of Artificial Sequence: Synthetic polypeptide
  XENP024025 Chain 1
EVQLLESGGGLVQPGGSLRLSCAASGFTFGSYAMSWVRQAPGKGLEWVSTITASGGTTFYADSVKGRFTISRDNSKNTLYLQMNSLRAEDTAVYYCAKDADGYGAIAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 726 - protein, 121 aa, Artificial Sequence
  Description of Artificial Sequence: Synthetic polypeptide
  VH of XENP024025
EVQLLESGGGLVQPGGSLRLSCAASGFTFGSYAMSWVRQAPGKGLEWVSTITASGGTTFYADSVKGRFTISRDNSKNTLYLQMNSLRAEDTAVYYCAKDADGYGAIAFDYWGQGTLVTVSS

SEQ ID NO: 727 - protein, 5 aa, Artificial Sequence
  Description of Artificial Sequence: Synthetic peptide
  XENP024025 vhCDR1
SYAMS

SEQ ID NO: 728 - protein, 17 aa, Artificial Sequence
  Description of Artificial Sequence: Synthetic peptide
  XENP024025 vhCDR2
TITASGGTTFYADSVKG

SEQ ID NO: 729 - protein, 12 aa, Artificial Sequence
  Description of Artificial Sequence: Synthetic peptide
  XENP024025 vhCDR3
DADGYGAIAFDY

SEQ ID NO: 730 - protein, 214 aa, Artificial Sequence
  Description of Artificial Sequence: Synthetic polypeptide
  XENP024025 Chain 2
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 731 - protein, 107 aa, Artificial Sequence
  Description of Artificial Sequence: Synthetic polypeptide
  VL of XENP024025
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 732 - protein, 11 aa, Artificial Sequence
  Description of Artificial Sequence: Synthetic peptide
  XENP024025 vlCDR1
RASQSISSYLN

SEQ ID NO: 733 - protein, 7 aa, Artificial Sequence
  Description of Artificial Sequence: Synthetic peptide
  XENP024025 vlCDR2
AASSLQS

SEQ ID NO: 734 - protein, 9 aa, Artificial Sequence
  Description of Artificial Sequence: Synthetic peptide
  XENP024025 vlCDR3
QQSYSTPYT

SEQ ID NO: 735 - protein, 450 aa, Artificial Sequence
  Description of Artificial Sequence: Synthetic polypeptide
  XENP024321 Chain 1
EVQLLESGGGLVQPGGSLRLSCAASGFTFGSYAMSWVRQAPGKGLEWVSTITASGGTTFYADSVKGRFTISRDNSKNTLYLQMNSLRAEDTAVYYCAKDADGYGAIAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 736 - protein, 121 aa, Artificial Sequence; identical to SEQ ID NO: 726
  Description of Artificial Sequence: Synthetic polypeptide
  VH of XENP024321

SEQ ID NO: 737 - protein, 5 aa, Artificial Sequence
  Description of Artificial Sequence: Synthetic peptide
  XENP024321 vhCDR1
SYAMS

SEQ ID NO: 738 - protein, 17 aa, Artificial Sequence
  Description of Artificial Sequence: Synthetic peptide
  XENP024321 vhCDR2
TITASGGTTFYADSVKG

SEQ ID NO: 739 - protein, 12 aa, Artificial Sequence
  Description of Artificial Sequence: Synthetic peptide
  XENP024321 vhCDR3
DADGYGAIAFDY

SEQ ID NO: 740 - protein, 214 aa, Artificial Sequence; identical to SEQ ID NO: 730
  Description of Artificial Sequence: Synthetic polypeptide
  XENP024321 Chain 2

SEQ ID NO: 741 - protein, 107 aa, Artificial Sequence; identical to SEQ ID NO: 731
  Description of Artificial Sequence: Synthetic polypeptide
  VL of XENP024321

SEQ ID NO: 742 - protein, 11 aa, Artificial Sequence
  Description of Artificial Sequence: Synthetic peptide
  XENP024321 vlCDR1
RASQSISSYLN

SEQ ID NO: 743 - protein, 7 aa, Artificial Sequence
  Description of Artificial Sequence: Synthetic peptide
  XENP024321 vlCDR2
AASSLQS

SEQ ID NO: 744 - protein, 9 aa, Artificial Sequence
  Description of Artificial Sequence: Synthetic peptide
  XENP024321 vlCDR3
QQSYSTPYT

SEQ ID NO: 745 - protein, 231 aa, Artificial Sequence; identical to SEQ ID NO: 68
  Description of Artificial Sequence: Synthetic polypeptide
  XENP024321 Chain 3

SEQ ID NO: 746 - protein, 435 aa, Artificial Sequence; identical to SEQ ID NO: 97
  Description of Artificial Sequence: Synthetic polypeptide
  XENP24736 Chain 1

SEQ ID NO: 747 - protein, 65 aa, Artificial Sequence; identical to SEQ ID NO: 4
  Description of Artificial Sequence: Synthetic polypeptide
  XENP24736 Human IL15Ralpha (sushi)

SEQ ID NO: 748 - protein, 114 aa, Artificial Sequence; identical to SEQ ID NO: 99
  Description of Artificial Sequence: Synthetic polypeptide
  XENP24736 Human IL15

SEQ ID NO: 749 - protein, 231 aa, Artificial Sequence; identical to SEQ ID NO: 44
  Description of Artificial Sequence: Synthetic polypeptide
  Fc Chain of XENP24736

SEQ ID NO: 750 - protein, 450 aa, Artificial Sequence
  Description of Artificial Sequence: Synthetic polypeptide
  XENP24736 Chain 2
EVQLLESGGGLVQPGGSLRLSCAASGFTFGSYAMSWVRQAPGKGLEWVSTITASGGTTFYADSVKGRFTISRDNSKNTLYLQMNSLRAEDTAVYYCAKDADGYGAIAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 751 - protein, 121 aa, Artificial Sequence; identical to SEQ ID NO: 726
  Description of Artificial Sequence: Synthetic polypeptide
  VH of XENP24736

SEQ ID NO: 752 - protein, 5 aa, Artificial Sequence
  Description of Artificial Sequence: Synthetic peptide
  XENP24736 vhCDR1
SYAMS

SEQ ID NO: 753 - protein, 17 aa, Artificial Sequence
  Description of Artificial Sequence: Synthetic peptide
  XENP24736 vhCDR2
TITASGGTTFYADSVKG

SEQ ID NO: 754 - protein, 12 aa, Artificial Sequence
  Description of Artificial Sequence: Synthetic peptide
  XENP24736 vhCDR3
DADGYGAIAFDY

SEQ ID NO: 755 - protein, 214 aa, Artificial Sequence; identical to SEQ ID NO: 730
  Description of Artificial Sequence: Synthetic polypeptide
  XENP24736 Chain 3

SEQ ID NO: 756 - protein, 107 aa, Artificial Sequence; identical to SEQ ID NO: 731
  Description of Artificial Sequence: Synthetic polypeptide
  VL of XENP24736

SEQ ID NO: 757 - protein, 11 aa, Artificial Sequence
  Description of Artificial Sequence: Synthetic peptide
  XENP24736 vlCDR1
RASQSISSYLN

SEQ ID NO: 758 - protein, 7 aa, Artificial Sequence
  Description of Artificial Sequence: Synthetic peptide
  XENP24736 vlCDR2
AASSLQS

SEQ ID NO: 759 - protein, 9 aa, Artificial Sequence
  Description of Artificial Sequence: Synthetic peptide
  XENP24736 vlCDR3
QQSYSTPYT

SEQ ID NO: 760 - protein, 118 aa, Artificial Sequence
  Description of Artificial Sequence: Synthetic polypeptide
  OKT8_H0.1 (Murine Variable Heavy)
QVKLQESGAELVKPGASVKLSCTASGFNIKDTYIHFVRQRPEQGLEWIGRIDPANDNTLYASKFQGKATITADTSSNTAYMHLSSLTSGDTAVYYCGRGYGYYVFDHWGQGTTVTVSS

SEQ ID NO: 761 - protein, 5 aa, Artificial Sequence
  Description of Artificial Sequence: Synthetic peptide
  OKT8_H0.1 vhCDR1
DTYIH

SEQ ID NO: 762 - protein, 17 aa, Artificial Sequence
  Description of Artificial Sequence: Synthetic peptide
  OKT8_H0.1 vhCDR2
RIDPANDNTLYASKFQG

SEQ ID NO: 763 - protein, 9 aa, Artificial Sequence
  Description of Artificial Sequence: Synthetic peptide
  OKT8_H0.1 vhCDR3
GYGYYVFDH

SEQ ID NO: 764 - protein, 118 aa, Artificial Sequence
  Description of Artificial Sequence: Synthetic polypeptide
  OKT8_H1 (Humanized Variable Heavy V1)
EVQLQQSGAEVKKPGASVKVSCKASGFNIKDTYIHWVRQAPGKGLEWMGRIDPANDNTLYASKFQGRVTITADTSTNTAYMELSSLRSEDTAVYYCGRGYGYYVFDHWGQGTTVTVSS

SEQ ID NO: 765 - protein, 5 aa, Artificial Sequence
  Description of Artificial Sequence: Synthetic peptide
  OKT8_H1 vhCDR1
DTYIH

SEQ ID NO: 766 - protein, 17 aa, Artificial Sequence
  Description of Artificial Sequence: Synthetic peptide
  OKT8_H1 vhCDR2
RIDPANDNTLYASKFQG

SEQ ID NO: 767 - protein, 9 aa, Artificial Sequence
  Description of Artificial Sequence: Synthetic peptide
  OKT8_H1 vhCDR3
GYGYYVFDH

SEQ ID NO: 768 - protein, 118 aa, Artificial Sequence
  Description of Artificial Sequence: Synthetic polypeptide
  OKT8_H2 (Humanized Variable Heavy V2)
QVQLVQSGAEVKKPGASVKVSCKASGFNIKDTYIHWVRQAPGKGLEWMGRIDPANDNTLYASKFQGRVTITADTSINTAYMELSRLRSDDTAVYYCGRGYGYYVFDHWGQGTTVTVSS

SEQ ID NO: 769 - protein, 5 aa, Artificial Sequence
  Description of Artificial Sequence: Synthetic peptide
  OKT8_H2 vhCDR1
DTYIH

SEQ ID NO: 770 - protein, 17 aa, Artificial Sequence
  Description of Artificial Sequence: Synthetic peptide
  OKT8_H2 vhCDR2
RIDPANDNTLYASKFQG

SEQ ID NO: 771 - protein, 9 aa, Artificial Sequence
  Description of Artificial Sequence: Synthetic peptide
  OKT8_H2 vhCDR3
GYGYYVFDH

SEQ ID NO: 772 - protein, 107 aa, Artificial Sequence
  Description of Artificial Sequence: Synthetic polypeptide
  OKT8_L0.1 (Murine Variable Light)
DIKMTQSPSFLAASPGETITINCRTSRSISQYLAWYQEKPGKTNKLLIYSGSTLQSGIPSRFSGSGSGTDFTLTISGLEPEDFAMYYCQQHNENPLTFGAGTKLEIK

SEQ ID NO: 773 - protein, 11 aa, Artificial Sequence
  Description of Artificial Sequence: Synthetic peptide
  OKT8_L0.1 vlCDR1
RTSRSISQYLA

SEQ ID NO: 774 - protein, 7 aa, Artificial Sequence
  Description of Artificial Sequence: Synthetic peptide
  OKT8_L0.1 vlCDR2
SGSTLQS

SEQ ID NO: 775 - protein, 9 aa, Artificial Sequence
  Description of Artificial Sequence: Synthetic peptide
  OKT8_L0.1 vlCDR3
QQHNENPLT

SEQ ID NO: 776 - protein, 107 aa, Artificial Sequence
  Description of Artificial Sequence: Synthetic polypeptide
  OKT8_L1 (Humanized Variable Light V1)
DIKMTQSPSSLSASVGDRVTITCRTSRSISQYLAWYQEKPGKTNKLLIYSGSTLQSGIPSRFSGSGSGTDFTLTISSLQPEDFATYYCQQHNENPLTFGAGTKLEIK

SEQ ID NO: 777 - protein, 11 aa, Artificial Sequence
  Description of Artificial Sequence: Synthetic peptide
  OKT8_L1 vlCDR1
RTSRSISQYLA

SEQ ID NO: 778 - protein, 7 aa, Artificial Sequence
  Description of Artificial Sequence: Synthetic peptide
  OKT8_L1 vlCDR2
SGSTLQS

SEQ ID NO: 779 - protein, 9 aa, Artificial Sequence
  Description of Artificial Sequence: Synthetic peptide
  OKT8_L1 vlCDR3
QQHNENPLT

SEQ ID NO: 780 - protein, 447 aa, Artificial Sequence
  Description of Artificial Sequence: Synthetic polypeptide
  XENP15075 OKT8_H1L1_IgG1_PVA_/S267K Heavy Chain
EVQLQQSGAEVKKPGASVKVSCKASGFNIKDTYIHWVRQAPGKGLEWMGRIDPANDNTLYASKFQGRVTITADTSTNTAYMELSSLRSEDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 781 - protein, 118 aa, Artificial Sequence; identical to SEQ ID NO: 764
  Description of Artificial Sequence: Synthetic polypeptide
  VH of XENP15075

SEQ ID NO: 782 - protein, 5 aa, Artificial Sequence
  Description of Artificial Sequence: Synthetic peptide
  XENP15075 vhCDR1
DTYIH

SEQ ID NO: 783 - protein, 17 aa, Artificial Sequence
  Description of Artificial Sequence: Synthetic peptide
  XENP15075 vhCDR2
RIDPANDNTLYASKFQG

SEQ ID NO: 784 - protein, 9 aa, Artificial Sequence
  Description of Artificial Sequence: Synthetic peptide
  XENP15075 vhCDR3
GYGYYVFDH

SEQ ID NO: 785 - protein, 214 aa, Artificial Sequence
  Description of Artificial Sequence: Synthetic polypeptide
  XENP15075 OKT8_H1L1_IgG1_PVA_/S267K Light Chain
DIKMTQSPSSLSASVGDRVTITCRTSRSISQYLAWYQEKPGKTNKLLIYSGSTLQSGIPSRFSGSGSGTDFTLTISSLQPEDFATYYCQQHNENPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 786 - protein, 107 aa, Artificial Sequence; identical to SEQ ID NO: 776
  Description of Artificial Sequence: Synthetic polypeptide
  VL of XENP15075

SEQ ID NO: 787 - protein, 11 aa, Artificial Sequence
  Description of Artificial Sequence: Synthetic peptide
  XENP15075 vlCDR1
RTSRSISQYLA

SEQ ID NO: 788 - protein, 7 aa, Artificial Sequence
  Description of Artificial Sequence: Synthetic peptide
  XENP15075 vlCDR2
SGSTLQS

SEQ ID NO: 789 - protein, 9 aa, Artificial Sequence
  Description of Artificial Sequence: Synthetic peptide
  XENP15075 vlCDR3
QQHNENPLT

SEQ ID NO: 790 - protein, 231 aa, Artificial Sequence; identical to SEQ ID NO: 44
  Description of Artificial Sequence: Synthetic polypeptide
  XENP24920 Chain 1

SEQ ID NO: 791 - protein, 447 aa, Artificial Sequence
  Description of Artificial Sequence: Synthetic polypeptide
  XENP24920 Chain 2
QVQLVQSGAEVKKPGASVKVSCKASGFNIKDTYIHWVRQAPGKGLEWMGRIDPANDNTLYASKFQGRVTITADTSINTAYMELSRLRSDDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 792 - protein, 118 aa, Artificial Sequence; identical to SEQ ID NO: 768
  Description of Artificial Sequence: Synthetic polypeptide
  VH of XENP24920

SEQ ID NO: 793 - protein, 5 aa, Artificial Sequence
  Description of Artificial Sequence: Synthetic peptide
  XENP24920 vhCDR1
DTYIH

SEQ ID NO: 794 - protein, 17 aa, Artificial Sequence
  Description of Artificial Sequence: Synthetic peptide
  XENP24920 vhCDR2
RIDPANDNTLYASKFQG

SEQ ID NO: 795 - protein, 9 aa, Artificial Sequence
  Description of Artificial Sequence: Synthetic peptide
  XENP24920 vhCDR3
GYGYYVFDH

SEQ ID NO: 796 - protein, 214 aa, Artificial Sequence; identical to SEQ ID NO: 785
  Description of Artificial Sequence: Synthetic polypeptide
  XENP24920 Chain 3

SEQ ID NO: 797 - protein, 107 aa, Artificial Sequence; identical to SEQ ID NO: 776
  Description of Artificial Sequence: Synthetic polypeptide
  VL of XENP24920

SEQ ID NO: 798 - protein, 11 aa, Artificial Sequence
  Description of Artificial Sequence: Synthetic peptide
  XENP24920 vlCDR1
RTSRSISQYLA

SEQ ID NO: 799 - protein, 7 aa, Artificial Sequence
  Description of Artificial Sequence: Synthetic peptide
  XENP24920 vlCDR2
SGSTLQS

SEQ ID NO: 800 - protein, 9 aa, Artificial Sequence
  Description of Artificial Sequence: Synthetic peptide
  XENP24920 vlCDR3
QQHNENPLT

SEQ ID NO: 801 - protein, 435 aa, Artificial Sequence; identical to SEQ ID NO: 97
  Description of Artificial Sequence: Synthetic polypeptide
  XENP24917 Chain 1

SEQ ID NO: 802 - protein, 65 aa, Artificial Sequence; identical to SEQ ID NO: 4
  Description of Artificial Sequence: Synthetic polypeptide
  XENP24917 Human IL15Ralpha (sushi)

SEQ ID NO: 803 - protein, 114 aa, Artificial Sequence; identical to SEQ ID NO: 99
  Description of Artificial Sequence: Synthetic polypeptide
  XENP24917 Human IL15

SEQ ID NO: 804 - protein, 231 aa, Artificial Sequence; identical to SEQ ID NO: 44
  Description of Artificial Sequence: Synthetic polypeptide
  Fc Chain of XENP24917

SEQ ID NO: 805 - protein, 447 aa, Artificial Sequence
  Description of Artificial Sequence: Synthetic polypeptide
  XENP24917 Chain 2
EVQLQQSGAEVKKPGASVKVSCKASGFNIKDTYIHWVRQAPGKGLEWMGRIDPANDNTLYASKFQGRVTITADTSTNTAYMELSSLRSEDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 806 - protein, 118 aa, Artificial Sequence; identical to SEQ ID NO: 764
  Description of Artificial Sequence: Synthetic polypeptide
  VH of XENP24917

SEQ ID NO: 807 - protein, 5 aa, Artificial Sequence
  Description of Artificial Sequence: Synthetic peptide
  XENP24917 vhCDR1
DTYIH

SEQ ID NO: 808 - protein, 17 aa, Artificial Sequence
  Description of Artificial Sequence: Synthetic peptide
  XENP24917 vhCDR2
RIDPANDNTLYASKFQG

SEQ ID NO: 809 - protein, 9 aa, Artificial Sequence
  Description of Artificial Sequence: Synthetic peptide
  XENP24917 vhCDR3
GYGYYVFDH

SEQ ID NO: 810 - protein, 214 aa, Artificial Sequence; identical to SEQ ID NO: 785
  Description of Artificial Sequence: Synthetic polypeptide
  XENP24917 Chain 3

SEQ ID NO: 811 - protein, 107 aa, Artificial Sequence; identical to SEQ ID NO: 776
  Description of Artificial Sequence: Synthetic polypeptide
  VL of XENP24917

SEQ ID NO: 812 - protein, 11 aa, Artificial Sequence
  Description of Artificial Sequence: Synthetic peptide
  XENP24917 vlCDR1
RTSRSISQYLA

SEQ ID NO: 813 - protein, 7 aa, Artificial Sequence
  Description of Artificial Sequence: Synthetic peptide
  XENP24917 vlCDR2
SGSTLQS

SEQ ID NO: 814 - protein, 9 aa, Artificial Sequence
  Description of Artificial Sequence: Synthetic peptide
  XENP24917 vlCDR3
QQHNENPLT

SEQ ID NO: 815 - protein, 435 aa, Artificial Sequence; identical to SEQ ID NO: 97
  Description of Artificial Sequence: Synthetic polypeptide
  XENP24918 Chain 1

SEQ ID NO: 816 - protein, 65 aa, Artificial Sequence; identical to SEQ ID NO: 4
  Description of Artificial Sequence: Synthetic polypeptide
  XENP24918 Human IL15Ralpha (sushi)

SEQ ID NO: 817 - protein, 114 aa, Artificial Sequence; identical to SEQ ID NO: 99
  Description of Artificial Sequence: Synthetic polypeptide
  XENP24918 Human IL15

SEQ ID NO: 818 - protein, 231 aa, Artificial Sequence; identical to SEQ ID NO: 44
  Description of Artificial Sequence: Synthetic polypeptide
  Fc Chain of XENP24918

SEQ ID NO: 819 - protein, 447 aa, Artificial Sequence; identical to SEQ ID NO: 791
  Description of Artificial Sequence: Synthetic polypeptide
  XENP24918 Chain 2

SEQ ID NO: 820 - protein, 118 aa, Artificial Sequence; identical to SEQ ID NO: 768
  Description of Artificial Sequence: Synthetic polypeptide
  VH of XENP24918

SEQ ID NO: 821 - protein, 5 aa, Artificial Sequence
  Description of Artificial Sequence: Synthetic peptide
  XENP24918 vhCDR1
DTYIH

SEQ ID NO: 822 - protein, 17 aa, Artificial Sequence
  Description of Artificial Sequence: Synthetic peptide
  XENP24918 vhCDR2
RIDPANDNTLYASKFQG

SEQ ID NO: 823 - protein, 9 aa, Artificial Sequence
  Description of Artificial Sequence: Synthetic peptide
  XENP24918 vhCDR3
GYGYYVFDH

SEQ ID NO: 824 - protein, 214 aa, Artificial Sequence; identical to SEQ ID NO: 785
  Description of Artificial Sequence: Synthetic polypeptide
  XENP24918 Chain 3

SEQ ID NO: 825 - protein, 107 aa, Artificial Sequence; identical to SEQ ID NO: 776
  Description of Artificial Sequence: Synthetic polypeptide
  VL of XENP24918

SEQ ID NO: 826 - protein, 11 aa, Artificial Sequence
  Description of Artificial Sequence: Synthetic peptide
  XENP24918 vlCDR1
RTSRSISQYLA

SEQ ID NO: 827 - protein, 7 aa, Artificial Sequence
  Description of Artificial Sequence: Synthetic peptide
  XENP24918 vlCDR2
SGSTLQS

SEQ ID NO: 828 - protein, 9 aa, Artificial Sequence
  Description of Artificial Sequence: Synthetic peptide
  XENP24918 vlCDR3
QQHNENPLT

SEQ ID NO: 829 - protein, 435 aa, Artificial Sequence; identical to SEQ ID NO: 97
  Description of Artificial Sequence: Synthetic polypeptide
  XENP24919 Chain 1

SEQ ID NO: 830 - protein, 65 aa, Artificial Sequence; identical to SEQ ID NO: 4
  Description of Artificial Sequence: Synthetic polypeptide
  XENP24919 Human IL15Ralpha (sushi)

SEQ ID NO: 831 - protein, 114 aa, Artificial Sequence; identical to SEQ ID NO: 99
  Description of Artificial Sequence: Synthetic polypeptide
  XENP24919 Human IL15

SEQ ID NO: 832 - protein, 231 aa, Artificial Sequence; identical to SEQ ID NO: 44
  Description of Artificial Sequence: Synthetic polypeptide
  Fc Chain of XENP24919

SEQ ID NO: 833 - protein, 447 aa, Artificial Sequence
  Description of Artificial Sequence: Synthetic polypeptide
  XENP24919 Chain 2
QVKLQESGAELVKPGASVKLSCTASGFNIKDTYIHFVRQRPEQGLEWIGRIDPANDNTLYASKFQGKATITADTSSNTAYMHLSSLTSGDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 834 - protein, 118 aa, Artificial Sequence; identical to SEQ ID NO: 760
  Description of Artificial Sequence: Synthetic polypeptide
  VH of XENP24919

SEQ ID NO: 835 - protein, 5 aa, Artificial Sequence
  Description of Artificial Sequence: Synthetic peptide
  XENP24919 vhCDR1
DTYIH

SEQ ID NO: 836 - protein, 17 aa, Artificial Sequence
  Description of Artificial Sequence: Synthetic peptide
  XENP24919 vhCDR2
RIDPANDNTLYASKFQG

SEQ ID NO: 837 - protein, 9 aa, Artificial Sequence
  Description of Artificial Sequence: Synthetic peptide
  XENP24919 vhCDR3
GYGYYVFDH

SEQ ID NO: 838 - protein, 214 aa, Artificial Sequence
  Description of Artificial Sequence: Synthetic polypeptide
  XENP24919 Chain 3
DIKMTQSPSFLAASPGETITINCRTSRSISQYLAWYQEKPGKTNKLLIYSGSTLQSGIPSRFSGSGSGTDFTLTISGLEPEDFAMYYCQQHNENPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 839 - protein, 107 aa, Artificial Sequence; identical to SEQ ID NO: 772
  Description of Artificial Sequence: Synthetic polypeptide
  VL of XENP24919

SEQ ID NO: 840 - protein, 11 aa, Artificial Sequence
  Description of Artificial Sequence: Synthetic peptide
  XENP24919 vlCDR1
RTSRSISQYLA

SEQ ID NO: 841 - protein, 7 aa, Artificial Sequence
  Description of Artificial Sequence: Synthetic peptide
  XENP24919 vlCDR2
SGSTLQS

SEQ ID NO: 842 - protein, 9 aa, Artificial Sequence
  Description of Artificial Sequence: Synthetic peptide
  XENP24919 vlCDR3
QQHNENPLT

SEQ ID NO: 843 - protein, 296 aa, Artificial Sequence; identical to SEQ ID NO: 158
  Description of Artificial Sequence: Synthetic polypeptide
  XENP25137 Chain 1

SEQ ID NO: 844 - protein, 65 aa, Artificial Sequence; identical to SEQ ID NO: 4
  Description of Artificial Sequence: Synthetic polypeptide
  XENP25137 Human IL15Ralpha (sushi)

SEQ ID NO: 845 - protein, 231 aa, Artificial Sequence; identical to SEQ ID NO: 44
  Description of Artificial Sequence: Synthetic polypeptide
  Fc Chain of XENP25137

SEQ ID NO: 846 - protein, 114 aa, Artificial Sequence; identical to SEQ ID NO: 298
  Description of Artificial Sequence: Synthetic polypeptide
  XENP25137 Chain 2

SEQ ID NO: 847 - protein, 447 aa, Artificial Sequence; identical to SEQ ID NO: 791
  Description of Artificial Sequence: Synthetic polypeptide
  XENP25137 Chain 3

SEQ ID NO: 848 - protein, 118 aa, Artificial Sequence; identical to SEQ ID NO: 768
  Description of Artificial Sequence: Synthetic polypeptide
  VH of XENP25137

SEQ ID NO: 849 - protein, 5 aa, Artificial Sequence
  Description of Artificial Sequence: Synthetic peptide
  XENP25137 vhCDR1
DTYIH

SEQ ID NO: 850 - protein, 17 aa, Artificial Sequence
  Description of Artificial Sequence: Synthetic peptide
  XENP25137 vhCDR2
RIDPANDNTLYASKFQG

SEQ ID NO: 851 - protein, 9 aa, Artificial Sequence
  Description of Artificial Sequence: Synthetic peptide
  XENP25137 vhCDR3
GYGYYVFDH

SEQ ID NO: 852 - protein, 214 aa, Artificial Sequence; identical to SEQ ID NO: 785
  Description of Artificial Sequence: Synthetic polypeptide
  XENP25137 Chain 4

SEQ ID NO: 853 - protein, 107 aa, Artificial Sequence; identical to SEQ ID NO: 776
  Description of Artificial Sequence: Synthetic polypeptide
  VL of XENP25137

SEQ ID NO: 854 - protein, 11 aa, Artificial Sequence
  Description of Artificial Sequence: Synthetic peptide
  XENP25137 vlCDR1
RTSRSISQYLA

SEQ ID NO: 855 - protein, 7 aa, Artificial Sequence
  Description of Artificial Sequence: Synthetic peptide
  XENP25137 vlCDR2
SGSTLQS

SEQ ID NO: 856 - protein, 9 aa, Artificial Sequence
  Description of Artificial Sequence: Synthetic peptide
  XENP25137 vlCDR3
QQHNENPLT

SEQ ID NO: 857 - protein, 118 aa, Artificial Sequence
  Description of Artificial Sequence: Synthetic polypeptide
  OKT8_H2.152 Variable Heavy
QVQLVQSGAEVKKPGASVKVSCKASGFNIKDTYIHWVRQAPGKGLEWMGRIDPDNGETLYASKFQGRVTITADTSINTAYMELSRLRSDDTAVYYCGRGYGYYVFDHWGQGTTVTVSS

SEQ ID NO: 858 - protein, 5 aa, Artificial Sequence
  Description of Artificial Sequence: Synthetic peptide
  OKT8_H2.152 vhCDR1
DTYIH

SEQ ID NO: 859 - protein, 17 aa, Artificial Sequence
  Description of Artificial Sequence: Synthetic peptide
  OKT8_H2.152 vhCDR2
RIDPDNGETLYASKFQG

SEQ ID NO: 860 - protein, 9 aa, Artificial Sequence
  Description of Artificial Sequence: Synthetic peptide
  OKT8_H2.152 vhCDR3
GYGYYVFDH

SEQ ID NO: 861 - protein, 118 aa, Artificial Sequence
  Description of Artificial Sequence: Synthetic polypeptide
  OKT8_H2.153 Variable Heavy
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGYGYYVFDHWGQGTTVTVSS

SEQ ID NO: 862 - protein, 5 aa, Artificial Sequence
  Description of Artificial Sequence: Synthetic peptide
  OKT8_H2.153 vhCDR1
DTYIH

SEQ ID NO: 863 - protein, 17 aa, Artificial Sequence
  Description of Artificial Sequence: Synthetic peptide
  OKT8_H2.153 vhCDR2
RIDPDNGETLYASKFQG

SEQ ID NO: 864 - protein, 9 aa, Artificial Sequence
  Description of Artificial Sequence: Synthetic peptide
  OKT8_H2.153 vhCDR3
GYGYYVFDH

SEQ ID NO: 865 - protein, 118 aa, Artificial Sequence
  Description of Artificial Sequence: Synthetic polypeptide
  OKT8_H2.154 Variable Heavy
QVQLVQSGAEVKKPGASVKVSCKASGFNIKDTYIHWVRQAPGKGLEWMGRIDPDNGETLYASKFQGRVTITADTSINTAYMELSRLRSDDTAVYYCGRGYGKYVFDHWGQGTTVTVSS

SEQ ID NO: 866 - protein, 5 aa, Artificial Sequence
  Description of Artificial Sequence: Synthetic peptide
  OKT8_H2.154 vhCDR1
DTYIH

SEQ ID NO: 867 - protein, 17 aa, Artificial Sequence
  Description of Artificial Sequence: Synthetic peptide
  OKT8_H2.154 vhCDR2
RIDPDNGETLYASKFQG

SEQ ID NO: 868 - protein, 9 aa, Artificial Sequence
  Description of Artificial Sequence: Synthetic peptide
  OKT8_H2.154 vhCDR3
GYGKYVFDH

SEQ ID NO: 869 - protein, 118 aa, Artificial Sequence
  Description of Artificial Sequence: Synthetic polypeptide
  OKT8_H2.155 Variable Heavy
QVQLVQSGAEVKKPGASVKVSCKASGFNIKDTYIHWVRQAPGKGLEWMGRIDPDNGETLYASKFQGRVTITADTSINTAYMELSRLRSDDTAVYYCGRGYGYYYFDHWGQGTTVTVSS

SEQ ID NO: 870 - protein, 5 aa, Artificial Sequence
  Description of Artificial Sequence: Synthetic peptide
  OKT8_H2.155 vhCDR1
DTYIH

SEQ ID NO: 871 - protein, 17 aa, Artificial Sequence
  Description of Artificial Sequence: Synthetic peptide
  OKT8_H2.155 vhCDR2
RIDPDNGETLYASKFQG

SEQ ID NO: 872 - protein, 9 aa, Artificial Sequence
  Description of Artificial Sequence: Synthetic peptide
  OKT8_H2.155 vhCDR3
GYGYYYFDH

SEQ ID NO: 873 - protein, 118 aa, Artificial Sequence
  Description of Artificial Sequence: Synthetic polypeptide
  OKT8_H2.156 Variable Heavy
QVQLVQSGAEVKKPGASVKVSCKASGFNIKDTYIHWVRQAPGKGLEWMGRIDPDNGETLYASKFQGRVTITADTSINTAYMELSRLRSDDTAVYYCGRGWGYYVFDHWGQGTTVTVSS

SEQ ID NO: 874 - protein, 5 aa, Artificial Sequence
  Description of Artificial Sequence: Synthetic peptide
  OKT8_H2.156 vhCDR1
DTYIH

SEQ ID NO: 875 - protein, 17 aa, Artificial Sequence
  Description of Artificial Sequence: Synthetic peptide
  OKT8_H2.156 vhCDR2
RIDPDNGETLYASKFQG

SEQ ID NO: 876 - protein, 9 aa, Artificial Sequence
  Description of Artificial Sequence: Synthetic peptide
  OKT8_H2.156 vhCDR3
GWGYYVFDH

SEQ ID NO: 877 - protein, 118 aa, Artificial Sequence
  Description of Artificial Sequence: Synthetic polypeptide
  OKT8_H2.157 Variable Heavy
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGYGKYVFDHWGQGTTVTVSS

SEQ ID NO: 878 - protein, 5 aa, Artificial Sequence
  Description of Artificial Sequence: Synthetic peptide
  OKT8_H2.157 vhCDR1
DTYIH

SEQ ID NO: 879 - protein, 17 aa, Artificial Sequence
  Description of Artificial Sequence: Synthetic peptide
  OKT8_H2.157 vhCDR2
RIDPDNGETLYASKFQG

SEQ ID NO: 880 - protein, 9 aa, Artificial Sequence
  Description of Artificial Sequence: Synthetic peptide
  OKT8_H2.157 vhCDR3
GYGKYVFDH

SEQ ID NO: 881 - protein, 118 aa, Artificial Sequence
  Description of Artificial Sequence: Synthetic polypeptide
  OKT8_H2.158 Variable Heavy
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGYGYYYFDHWGQGTTVTVSS

SEQ ID NO: 882 - protein, 5 aa, Artificial Sequence
  Description of Artificial Sequence: Synthetic peptide
  OKT8_H2.158 vhCDR1
DTYIH

SEQ ID NO: 883 - protein, 17 aa, Artificial Sequence
  Description of Artificial Sequence: Synthetic peptide
  OKT8_H2.158 vhCDR2
RIDPDNGETLYASKFQG

SEQ ID NO: 884 - protein, 9 aa, Artificial Sequence
  Description of Artificial Sequence: Synthetic peptide
  OKT8_H2.158 vhCDR3
GYGYYYFDH

SEQ ID NO: 885 - protein, 118 aa, Artificial Sequence
  Description of Artificial Sequence: Synthetic polypeptide
  OKT8_H2.159 Variable Heavy
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGWGYYVFDHWGQGTTVTVSS

SEQ ID NO: 886 - protein, 5 aa, Artificial Sequence
  Description of Artificial Sequence: Synthetic peptide
  OKT8_H2.159 vhCDR1
DTYIH

SEQ ID NO: 887 - protein, 17 aa, Artificial Sequence
  Description of Artificial Sequence: Synthetic peptide
  OKT8_H2.159 vhCDR2
RIDPDNGETLYASKFQG

SEQ ID NO: 888 - protein, 9 aa, Artificial Sequence
  Description of Artificial Sequence: Synthetic peptide
  OKT8_H2.159 vhCDR3
GWGYYVFDH

SEQ ID NO: 889 - protein, 118 aa, Artificial Sequence
  Description of Artificial Sequence: Synthetic polypeptide
  OKT8_H2.160 Variable Heavy
QVQLVQSGAEVKKPGASVKVSCKASGFNIKDTYIHWVRQAPGKGLEWMGRIDPDNDETLYASKFQGRVTMTADTSINTAYMELSRLRSDDTAVYYCGRGYGYYVFDHWGQGTTVTVSS

SEQ ID NO: 890 - protein, 5 aa, Artificial Sequence
  Description of Artificial Sequence: Synthetic peptide
  OKT8_H2.160 vhCDR1
DTYIH

SEQ ID NO: 891 - protein, 17 aa, Artificial Sequence
  Description of Artificial Sequence: Synthetic peptide
  OKT8_H2.160 vhCDR2
RIDPDNDETLYASKFQG

SEQ ID NO: 892 - protein, 9 aa, Artificial Sequence
  Description of Artificial Sequence: Synthetic peptide
  OKT8_H2.160 vhCDR3
GYGYYVFDH

SEQ ID NO: 893 - protein, 118 aa, Artificial Sequence
  Description of Artificial Sequence: Synthetic polypeptide
  OKT8_H2.161 Variable Heavy
QVQLVQSGAEVKKPGASVKVSCKASGFNIKDTYIHWVRQAPGKGLEWMGRIDPDNDETLYASKFQGRVTITADTSINTAYMELSRLRSDDTAVYYCGRGYGKYVFDHWGQGTTVTVSS

SEQ ID NO: 894 - protein, 5 aa, Artificial Sequence
  Description of Artificial Sequence: Synthetic peptide
  OKT8_H2.161 vhCDR1
DTYIH

SEQ ID NO: 895 - protein, 17 aa, Artificial Sequence
  Description of Artificial Sequence: Synthetic peptide
  OKT8_H2.161 vhCDR2
RIDPDNDETLYASKFQG

SEQ ID NO: 896 - protein, 9 aa, Artificial Sequence
  Description of Artificial Sequence: Synthetic peptide
  OKT8_H2.161 vhCDR3
GYGKYVFDH

SEQ ID NO: 897 - protein, 118 aa, Artificial Sequence
  Description of Artificial Sequence: Synthetic polypeptide
  OKT8_H2.162 Variable Heavy
QVQLVQSGAEVKKPGASVKVSCKASGFNIKDTYIHWVRQAPGKGLEWMGRIDPDNDETLYASKFQGRVTITADTSINTAYMELSRLRSDDTAVYYCGRGYGYYYFDHWGQGTTVTVSS

SEQ ID NO: 898 - protein, 5 aa, Artificial Sequence
  Description of Artificial Sequence: Synthetic peptide
  OKT8_H2.162 vhCDR1
DTYIH

SEQ ID NO: 899 - protein, 17 aa, Artificial Sequence
  Description of Artificial Sequence: Synthetic peptide
  OKT8_H2.162 vhCDR2
RIDPDNDETLYASKFQG

SEQ ID NO: 900 - protein, 9 aa, Artificial Sequence
  Description of Artificial Sequence: Synthetic peptide
  OKT8_H2.162 vhCDR3
GYGYYYFDH

SEQ ID NO: 901 - protein, 118 aa, Artificial Sequence
  Description of Artificial Sequence: Synthetic polypeptide
  OKT8_H2.163 Variable Heavy
QVQLVQSGAEVKKPGASVKVSCKASGFNIKDTYIHWVRQAPGKGLEWMGRIDPDNDETLYASKFQGRVTITADTSINTAYMELSRLRSDDTAVYYCGRGWGYYVFDHWGQGTTVTVSS

SEQ ID NO: 902 - protein, 5 aa, Artificial Sequence
  Description of Artificial Sequence: Synthetic peptide
  OKT8_H2.163 vhCDR1
DTYIH

SEQ ID NO: 903 - protein, 17 aa, Artificial Sequence
  Description of Artificial Sequence: Synthetic peptide
  OKT8_H2.163 vhCDR2
RIDPDNDETLYASKFQG

SEQ ID NO: 904 - protein, 9 aa, Artificial Sequence
  Description of Artificial Sequence: Synthetic peptide
  OKT8_H2.163 vhCDR3
GWGYYVFDH

SEQ ID NO: 905 - protein, 118 aa, Artificial Sequence
  Description of Artificial Sequence: Synthetic polypeptide
  OKT8_H2.164 Variable Heavy
QVQLVQSGAEVKKPGASVKVSCKASGFNIKDTYIHWVRQAPGKGLEWMGRIDPDNDETLYASKFQGRVTMTADTSINTAYMELSRLRSDDTAVYYCGRGYGKYVFDHWGQGTTVTVSS

SEQ ID NO: 906 - protein, 5 aa, Artificial Sequence
  Description of Artificial Sequence: Synthetic peptide
  OKT8_H2.164 vhCDR1
DTYIH

SEQ ID NO: 907 - protein, 17 aa, Artificial Sequence
  Description of Artificial Sequence: Synthetic peptide
  OKT8_H2.164 vhCDR2
RIDPDNDETLYASKFQG

SEQ ID NO: 908 - protein, 9 aa, Artificial Sequence
  Description of Artificial Sequence: Synthetic peptide
  OKT8_H2.164 vhCDR3
GYGKYVFDH

SEQ ID NO: 909 - protein, 118 aa, Artificial Sequence
  Description of Artificial Sequence: Synthetic polypeptide
  OKT8_H2.165 Variable Heavy
QVQLVQSGAEVKKPGASVKVSCKASGFNIKDTYIHWVRQAPGKGLEWMGRIDPDNDETLYASKFQGRVTMTADTSINTAYMELSRLRSDDTAVYYCGRGYGYYYFDHWGQGTTVTVSS

SEQ ID NO: 910 - protein, 5 aa, Artificial Sequence
  Description of Artificial Sequence: Synthetic peptide
  OKT8_H2.165 vhCDR1
DTYIH

SEQ ID NO: 911 - protein, 17 aa, Artificial Sequence
  Description of Artificial Sequence: Synthetic peptide
  OKT8_H2.165 vhCDR2
RIDPDNDETLYASKFQG

SEQ ID NO: 912 - protein, 9 aa, Artificial Sequence
  Description of Artificial Sequence: Synthetic peptide
  OKT8_H2.165 vhCDR3
GYGYYYFDH

SEQ ID NO: 913 - protein, 118 aa, Artificial Sequence
  Description of Artificial Sequence: Synthetic polypeptide
  OKT8_H2.166 Variable Heavy
QVQLVQSGAEVKKPGASVKVSCKASGFNIKDTYIHWVRQAPGKGLEWMGRIDPDNDETLYASKFQGRVTMTADTSINTAYMELSRLRSDDTAVYYCGRGWGYYVFDHWGQGTTVTVSS

SEQ ID NO: 914 - protein, 5 aa, Artificial Sequence
  Description of Artificial Sequence: Synthetic peptide
  OKT8_H2.166 vhCDR1
DTYIH

SEQ ID NO: 915 - protein, 17 aa, Artificial Sequence
  Description of Artificial Sequence: Synthetic peptide
  OKT8_H2.166 vhCDR2
RIDPDNDETLYASKFQG

SEQ ID NO: 916 - protein, 9 aa, Artificial Sequence
  Description of Artificial Sequence: Synthetic peptide
  OKT8_H2.166 vhCDR3
GWGYYVFDH

SEQ ID NO: 917 - protein, 107 aa, Artificial Sequence
  Description of Artificial Sequence: Synthetic polypeptide
  OKT8_L1.103 Variable Light
AIKMTQSPSSLSASVGDRVTITCRTSRSISKYLAWYQEKPGKTNKLLIYSGSTLQSGIPSRFSGSGSGTDFTLTISSLQPEDFATYYCQQHNENPLTFGAGTKLEIK

SEQ ID NO: 918 - protein, 11 aa, Artificial Sequence
  Description of Artificial Sequence: Synthetic peptide
  OKT8_L1.103 vlCDR1
RTSRSISKYLA

SEQ ID NO: 919 - protein, 7 aa, Artificial Sequence
  Description of Artificial Sequence: Synthetic peptide
  OKT8_L1.103 vlCDR2
SGSTLQS

SEQ ID NO: 920 - protein, 9 aa, Artificial Sequence
  Description of Artificial Sequence: Synthetic peptide
  OKT8_L1.103 vlCDR3
QQHNENPLT

SEQ ID NO: 921 - protein, 107 aa, Artificial Sequence
  Description of Artificial Sequence: Synthetic polypeptide
  OKT8_L1.113 Variable Light
AIKMTQSPSSLSASVGDRVTITCRTSRSISIYLAWYQEKPGKTNKLLIYKGSTLQSGIPSRFSGSGSGTDFTLTISSLQPEDFATYYCQQANENPLTFGAGTKLEIK

SEQ ID NO: 922 - protein, 11 aa, Artificial Sequence
  Description of Artificial Sequence: Synthetic peptide
  OKT8_L1.113 vlCDR1
RTSRSISIYLA

SEQ ID NO: 923 - protein, 7 aa, Artificial Sequence
  Description of Artificial Sequence: Synthetic peptide
  OKT8_L1.113 vlCDR2
KGSTLQS

SEQ ID NO: 924 - protein, 9 aa, Artificial Sequence
  Description of Artificial Sequence: Synthetic peptide
  OKT8_L1.113 vlCDR3
QQANENPLT

SEQ ID NO: 925 - protein, 435 aa, Artificial Sequence; identical to SEQ ID NO: 97
  Description of Artificial Sequence: Synthetic polypeptide
  XENP26223 Chain 1

SEQ ID NO: 926 - protein, 65 aa, Artificial Sequence; identical to SEQ ID NO: 4
  Description of Artificial Sequence: Synthetic polypeptide
  XENP26223 Human IL15Ralpha (sushi)

SEQ ID NO: 927 - protein, 114 aa, Artificial Sequence; identical to SEQ ID NO: 99
  Description of Artificial Sequence: Synthetic polypeptide
  XENP26223 Human IL15

SEQ ID NO: 928 - protein, 231 aa, Artificial Sequence; identical to SEQ ID NO: 44
  Description of Artificial Sequence: Synthetic polypeptide
  Fc Chain of XENP26223

SEQ ID NO: 929 - protein, 447 aa, Artificial Sequence
  Description of Artificial Sequence: Synthetic polypeptide
  XENP26223 Chain 2
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGYGKYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 930 - protein, 118 aa, Artificial Sequence; identical to SEQ ID NO: 877
  Description of Artificial Sequence: Synthetic polypeptide
  VH of XENP26223

SEQ ID NO: 931 - protein, 5 aa, Artificial Sequence
  Description of Artificial Sequence: Synthetic peptide
  XENP26223 vhCDR1
DTYIH

SEQ ID NO: 932 - protein, 17 aa, Artificial Sequence
  Description of Artificial Sequence: Synthetic peptide
  XENP26223 vhCDR2
RIDPDNGETLYASKFQG

SEQ ID NO: 933 - protein, 9 aa, Artificial Sequence
  Description of Artificial Sequence: Synthetic peptide
  XENP26223 vhCDR3
GYGKYVFDH

SEQ ID NO: 934 - protein, 214 aa, Artificial Sequence
  Description of Artificial Sequence: Synthetic polypeptide
  XENP26223 Chain 3
AIKMTQSPSSLSASVGDRVTITCRTSRSISKYLAWYQEKPGKTNKLLIYSGSTLQSGIPSRFSGSGSGTDFTLTISSLQPEDFATYYCQQHNENPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 935 - protein, 107 aa, Artificial Sequence; identical to SEQ ID NO: 917
  Description of Artificial Sequence: Synthetic polypeptide
  VL of XENP26223

SEQ ID NO: 936 - protein, 11 aa, Artificial Sequence
  Description of Artificial Sequence: Synthetic peptide
  XENP26223 vlCDR1
RTSRSISKYLA

SEQ ID NO: 937 - protein, 7 aa, Artificial Sequence
  Description of Artificial Sequence: Synthetic peptide
  XENP26223 vlCDR2
SGSTLQS

SEQ ID NO: 938 - protein, 9 aa, Artificial Sequence
  Description of Artificial Sequence: Synthetic peptide
  XENP26223 vlCDR3
QQHNENPLT

SEQ ID NO: 939 - protein, 435 aa, Artificial Sequence; identical to SEQ ID NO: 97
  Description of Artificial Sequence: Synthetic polypeptide
  XENP26224 Chain 1

SEQ ID NO: 940 - protein, 65 aa, Artificial Sequence; identical to SEQ ID NO: 4
  Description of Artificial Sequence: Synthetic polypeptide
  XENP26224 Human IL15Ralpha (sushi)

SEQ ID NO: 941 - protein, 114 aa, Artificial Sequence; identical to SEQ ID NO: 99
  Description of Artificial Sequence: Synthetic polypeptide
  XENP26224 Human IL15

SEQ ID NO: 942 - protein, 231 aa, Artificial Sequence; identical to SEQ ID NO: 44
  Description of Artificial Sequence: Synthetic polypeptide
  Fc Chain of XENP26224

SEQ ID NO: 943 - protein, 447 aa, Artificial Sequence
  Description of Artificial Sequence: Synthetic polypeptide
  XENP26224 Chain 2
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGYGYYYFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 944 - protein, 118 aa, Artificial Sequence; identical to SEQ ID NO: 881
  Description of Artificial Sequence: Synthetic polypeptide
  VH of XENP26224

SEQ ID NO: 945 - protein, 5 aa, Artificial Sequence
  Description of Artificial Sequence: Synthetic peptide
  XENP26224 vhCDR1
DTYIH

SEQ ID NO: 946 - protein, 17 aa, Artificial Sequence
  Description of Artificial Sequence: Synthetic peptide
  XENP26224 vhCDR2
RIDPDNGETLYASKFQG

SEQ ID NO: 947 - protein, 9 aa, Artificial Sequence
  Description of Artificial Sequence: Synthetic peptide
  XENP26224 vhCDR3
GYGYYYFDH

SEQ ID NO: 948 - protein, 214 aa, Artificial Sequence; identical to SEQ ID NO: 934
  Description of Artificial Sequence: Synthetic polypeptide
  XENP26224 Chain 3

SEQ ID NO: 949 - protein, 107 aa, Artificial Sequence; identical to SEQ ID NO: 917
  Description of Artificial Sequence: Synthetic polypeptide
  VL of XENP26224

SEQ ID NO: 950 - protein, 11 aa, Artificial Sequence
  Description of Artificial Sequence: Synthetic peptide
  XENP26224 vlCDR1
RTSRSISKYLA

SEQ ID NO: 951 - protein, 7 aa, Artificial Sequence
  Description of Artificial Sequence: Synthetic peptide
  XENP26224 vlCDR2
SGSTLQS

SEQ ID NO: 952 - protein, 9 aa, Artificial Sequence
  Description of Artificial Sequence: Synthetic peptide
  XENP26224 vlCDR3
QQHNENPLT

SEQ ID NO: 953 - protein, 435 aa, Artificial Sequence; identical to SEQ ID NO: 97
  Description of Artificial Sequence: Synthetic polypeptide
  XENP26227 Chain 1

SEQ ID NO: 954 - protein, 65 aa, Artificial Sequence; identical to SEQ ID NO: 4
  Description of Artificial Sequence: Synthetic polypeptide
  XENP26227 Human IL15Ralpha (sushi)

SEQ ID NO: 955 - protein, 114 aa, Artificial Sequence; identical to SEQ ID NO: 99
  Description of Artificial Sequence: Synthetic polypeptide
  XENP26227 Human IL15

SEQ ID NO: 956 - protein, 231 aa, Artificial Sequence; identical to SEQ ID NO: 44
  Description of Artificial Sequence: Synthetic polypeptide
  Fc Chain of XENP26227

SEQ ID NO: 957 - protein, 447 aa, Artificial Sequence
  Description of Artificial Sequence: Synthetic polypeptide
  XENP26227 Chain 2
QVQLVQSGAEVKKPGASVKVSCKASGFNIKDTYIHWVRQAPGKGLEWMGRIDPDNDETLYASKFQGRVTMTADTSINTAYMELSRLRSDDTAVYYCGRGYGKYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 958 - protein, 118 aa, Artificial Sequence; identical to SEQ ID NO: 905
  Description of Artificial Sequence: Synthetic polypeptide
  VH of XENP26227

SEQ ID NO: 959 - protein, 5 aa, Artificial Sequence
  Description of Artificial Sequence: Synthetic peptide
  XENP26227 vhCDR1
DTYIH

SEQ ID NO: 960 - protein, 17 aa, Artificial Sequence
  Description of Artificial Sequence: Synthetic peptide
  XENP26227 vhCDR2
RIDPDNDETLYASKFQG

SEQ ID NO: 961 - protein, 9 aa, Artificial Sequence
  Description of Artificial Sequence: Synthetic peptide
  XENP26227 vhCDR3
GYGKYVFDH

SEQ ID NO: 962 - protein, 214 aa, Artificial Sequence; identical to SEQ ID NO: 934
  Description of Artificial Sequence: Synthetic polypeptide
  XENP26227 Chain 3

SEQ ID NO: 963 - protein, 107 aa, Artificial Sequence; identical to SEQ ID NO: 917
  Description of Artificial Sequence: Synthetic polypeptide
  VL of XENP26227

SEQ ID NO: 964 - protein, 11 aa, Artificial Sequence
  Description of Artificial Sequence: Synthetic peptide
  XENP26227 vlCDR1
RTSRSISKYLA

SEQ ID NO: 965 - protein, 7 aa, Artificial Sequence
  Description of Artificial Sequence: Synthetic peptide
  XENP26227 vlCDR2
SGSTLQS

SEQ ID NO: 966 - protein, 9 aa, Artificial Sequence
  Description of Artificial Sequence: Synthetic peptide
  XENP26227 vlCDR3
QQHNENPLT

SEQ ID NO: 967 - protein, 435 aa, Artificial Sequence; identical to SEQ ID NO: 97
  Description of Artificial Sequence: Synthetic polypeptide
  XENP26229 Chain 1

SEQ ID NO: 968 - protein, 65 aa, Artificial Sequence; identical to SEQ ID NO: 4
  Description of Artificial Sequence: Synthetic polypeptide
  XENP26229 Human IL15Ralpha (sushi)

SEQ ID NO: 969 - protein, 114 aa, Artificial Sequence; identical to SEQ ID NO: 99
  Description of Artificial Sequence: Synthetic polypeptide
  XENP26229 Human IL15

SEQ ID NO: 970 - protein, 231 aa, Artificial Sequence; identical to SEQ ID NO: 44
  Description of Artificial Sequence: Synthetic polypeptide
  Fc Chain of XENP26229

SEQ ID NO: 971 - protein, 447 aa, Artificial Sequence
  Description of Artificial Sequence: Synthetic polypeptide
  XENP26229 Chain 2
QVQLVQSGAEVKKPGASVKVSCKASGFNIKDTYIHWVRQAPGKGLEWMGRIDPDNDETLYASKFQGRVTMTADTSINTAYMELSRLRSDDTAVYYCGRGWGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 972 - protein, 118 aa, Artificial Sequence; identical to SEQ ID NO: 913
  Description of Artificial Sequence: Synthetic polypeptide
  VH of XENP26229

SEQ ID NO: 973 - protein, 5 aa, Artificial Sequence
  Description of Artificial Sequence: Synthetic peptide
  XENP26229 vhCDR1
DTYIH

SEQ ID NO: 974 - protein, 17 aa, Artificial Sequence
  Description of Artificial Sequence: Synthetic peptide
  XENP26229 vhCDR2
RIDPDNDETLYASKFQG

SEQ ID NO: 975 - protein, 9 aa, Artificial Sequence
  Description of Artificial Sequence: Synthetic peptide
  XENP26229 vhCDR3
GWGYYVFDH

SEQ ID NO: 976 - protein, 214 aa, Artificial Sequence; identical to SEQ ID NO: 934
  Description of Artificial Sequence: Synthetic polypeptide
  XENP26229 Chain 3

SEQ ID NO: 977 - protein, 107 aa, Artificial Sequence; identical to SEQ ID NO: 917
  Description of Artificial Sequence: Synthetic polypeptide
  VL of XENP26229

SEQ ID NO: 978 - protein, 11 aa, Artificial Sequence
  Description of Artificial Sequence: Synthetic peptide
  XENP26229 vlCDR1
RTSRSISKYLA

SEQ ID NO: 979 - protein, 7 aa, Artificial Sequence
  Description of Artificial Sequence: Synthetic peptide
  XENP26229 vlCDR2
SGSTLQS

SEQ ID NO: 980 - protein, 9 aa, Artificial Sequence
  Description of Artificial Sequence: Synthetic peptide
  XENP26229 vlCDR3
QQHNENPLT

SEQ ID NO: 981 - protein, 435 aa, Artificial Sequence; identical to SEQ ID NO: 392
  Description of Artificial Sequence: Synthetic polypeptide
  XENP26585 Chain 1

SEQ ID NO: 982 - protein, 65 aa, Artificial Sequence; identical to SEQ ID NO: 4
  Description of Artificial Sequence: Synthetic polypeptide
  XENP26585 Human IL15Ralpha (sushi)

SEQ ID NO: 983 - protein, 114 aa, Artificial Sequence; identical to SEQ ID NO: 99
  Description of Artificial Sequence: Synthetic polypeptide
  XENP26585 Human IL15

SEQ ID NO: 984 - protein, 231 aa, Artificial Sequence; identical to SEQ ID NO: 64
  Description of Artificial Sequence: Synthetic polypeptide
  Fc Chain of XENP26585

SEQ ID NO: 985 - protein, 447 aa, Artificial Sequence
  Description of Artificial Sequence: Synthetic polypeptide
  XENP26585 Chain 2
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGYGKYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 986 - protein, 118 aa, Artificial Sequence; identical to SEQ ID NO: 877
  Description of Artificial Sequence: Synthetic polypeptide
  VH of XENP26585

SEQ ID NO: 987 - protein, 5 aa, Artificial Sequence
  Description of Artificial Sequence: Synthetic peptide
  XENP26585 vhCDR1
DTYIH

SEQ ID NO: 988 - protein, 17 aa, Artificial Sequence
  Description of Artificial Sequence: Synthetic peptide
  XENP26585 vhCDR2
RIDPDNGETLYASKFQG

SEQ ID NO: 989 - protein, 9 aa, Artificial Sequence
  Description of Artificial Sequence: Synthetic peptide
  XENP26585 vhCDR3
GYGKYVFDH

SEQ ID NO: 990 - protein, 214 aa, Artificial Sequence; identical to SEQ ID NO: 934
  Description of Artificial Sequence: Synthetic polypeptide
  XENP26585 Chain 3

SEQ ID NO: 991 - protein, 107 aa, Artificial Sequence; identical to SEQ ID NO: 917
  Description of Artificial Sequence: Synthetic polypeptide
  VL of XENP26585

SEQ ID NO: 992 - protein, 11 aa, Artificial Sequence
  Description of Artificial Sequence: Synthetic peptide
  XENP26585 vlCDR1
RTSRSISKYLA

SEQ ID NO: 993 - protein, 7 aa, Artificial Sequence
  Description of Artificial Sequence: Synthetic peptide
  XENP26585 vlCDR2
SGSTLQS

SEQ ID NO: 994 - protein, 9 aa, Artificial Sequence
  Description of Artificial Sequence: Synthetic peptide
  XENP26585 vlCDR3
QQHNENPLT

What is claimed is:

1. A bifunctional heterodimeric protein comprising:
a) an IL-15/IL-15Rα fusion protein comprising a human IL-15Rα protein having the amino acid sequence of SEQ ID NO:4, a human IL-15 variant protein having the amino acid sequence of SEQ ID NO:2 and comprising one or more amino acid substitutions, and a first Fc domain,
wherein said human IL-15Rα protein is covalently attached to the N-terminus of said human IL-15 variant protein using a first domain linker and said human IL-15 variant protein is covalently attached to the N-terminus of said first Fc domain using a second domain linker, or
wherein said human IL-15 variant protein is covalently attached to the N-terminus of said human IL-15Rα protein using a first domain linker and said human IL-15Rα protein is covalently attached to the N-terminus of said first Fc domain using a second domain linker; and
b) an antigen binding domain monomer comprising a heavy chain comprising a VH-CH1-hinge-CH2-CH3 monomer, wherein VH is a variable heavy chain and CH2-CH3 is a second Fc domain, and a light chain comprising a variable light chain (VL) and a light constant domain (CL), wherein said first and said second Fc domains are variants of a human IgG1 Fc domain and have a set of amino acid substitutions selected from the group consisting of S267K/L368D/K370S:S267K/S364K/E357Q; S364K/E357Q: L368D/K370S; L368D/K370S:S 364K; L368E/K370S:S364K; T411E/K360E/Q362E:D401K; L368D/K370S:S364K/E357L and K370S:S364K/E357Q, according to EU numbering, and wherein said antigen binding domain monomer binds human CD8.

2. The bifunctional heterodimeric protein according to claim 1, wherein said first and/or said second Fc domains are variants of a human IgG1 Fc domain and have an additional set of amino acid substitutions comprising Q295E/N384D/Q418E/N421D, according to EU numbering.

3. The bifunctional heterodimeric protein according to claim 1, wherein said first and/or said second Fc domains are variants of a human IgG1 Fc domain and have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

4. The bifunctional heterodimeric protein according to claim 1, wherein said human IL-15 variant protein and said human IL-15Rα protein have a set of amino acid substitutions selected from the group consisting of E87C:D96/P97/C98; E87C:D 96/C97/A98; V49C:S40C; L52C:S40C; E89C:K34C; Q48C:G38C; E53C:L42C; C42S:A 37C; and L45C:A37C, respectively.

5. The bifunctional heterodimeric protein according to claim 1, wherein said human IL-15 variant protein has one or more amino acid substitutions selected from the group consisting of N1D, N4D, D8N, D3ON, D61N, E64Q, N65D, and Q108E.

6. The bifunctional heterodimeric protein according to claim 1, wherein said human IL-15 variant protein comprises the amino acid substitutions N4D/N65D or D3ON/E64Q/N65D.

7. The bifunctional heterodimeric protein according to claim 1, wherein said bifunctional heterodimeric protein is any one selected from the group consisting of (a) SEQ ID NOS: 626, 630 and 635; (b) SEQ ID NOS: 640, 644 and 649; (c) SEQ ID NOS: 746, 750 and 755; (d) SEQ ID NOS: 801, 805 and 810; (e) SEQ ID NOS: 815, 819 and 824; (f) SEQ ID NOS: 829, 833 and 838; (g) SEQ ID NOS: 925, 929 and 934; (h) SEQ ID NOS: 939, 943 and 948; (i) SEQ ID NOS: 953, 957 and 962; (j) SEQ ID NOS: 967, 971 and 976; and (k) SEQ ID NOS: 981, 985 and 990.

8. A nucleic acid composition comprising:
a) a first nucleic acid encoding said IL-15/IL-15Rα fusion protein of claim 1; and
b) a second nucleic acid encoding said antigen binding domain monomer of claim 1.

9. An expression vector composition comprising:
a) a first expression vector comprising said first nucleic acid of claim 8; and
b) a second expression vector comprising said second nucleic acid of claim 8.

10. A host cell comprising said expression vector composition of claim 9.

11. A method of making a bifunctional heterodimeric protein comprising culturing the host cell of claim 10 under conditions wherein said bifunctional heterodimeric protein is expressed, and recovering said heterodimeric protein.

12. A bifunctional heterodimeric protein selected from the group consisting of (a) SEQ ID NOS: 626, 630 and 635; (b) SEQ ID NOS: 640, 644 and 649; (c) SEQ ID NOS: 746, 750 and 755; (d) SEQ ID NOS: 801, 805 and 810; (e) SEQ ID NOS: 815, 819 and 824; (f) SEQ ID NOS: 829, 833 and 838; (g) SEQ ID NOS: 925, 929 and 934; (h) SEQ ID NOS: 939, 943 and 948; (i) SEQ ID NOS: 953, 957 and 962; (j) SEQ ID NOS: 967, 971 and 976; and (k) SEQ ID NOS: 981, 985 and 990.

13. A method of treating cancer in a patient in need thereof comprising administering a therapeutically effective amount of the bifunctional heterodimeric protein of claim 12 to said patient.

14. An expression vector composition comprising one or more expression vectors each comprising a nucleic acid such that the one or more expression vectors encode a bifunctional heterodimeric protein selected from the group consisting of (a) SEQ ID NOS: 626, 630 and 635; (b) SEQ ID NOS: 640, 644 and 649; (c) SEQ ID NOS: 746, 750 and 755; (d) SEQ ID NOS: 801, 805 and 810; (e) SEQ ID NOS: 815, 819 and 824; (f) SEQ ID NOS: 829, 833 and 838; (g) SEQ ID NOS: 925, 929 and 934; (h) SEQ ID NOS: 939, 943 and 948; (i) SEQ ID NOS: 953, 957 and 962; (j) SEQ ID NOS: 967, 971 and 976; and (k) SEQ ID NOS: 981, 985 and 990.

15. A host cell comprising the expression vector composition of claim 14.

16. A method of producing a bifunctional heterodimeric protein comprising (a) culturing the host cell of claim 15 under suitable conditions wherein said bifunctional heterodimeric protein is expressed, and (b) recovering said protein.

* * * * *